United States Patent 10,695,415 (LIVE ATTENUATED ORAL VACCINE AGAINST SHIGELLOSIS AND TYPHOID FEVER) - sequence listing, part 11

SEQ ID NO: 4 - DNA, 4803563 bp, Artificial Sequence (residues 1,601,189-3,202,376 of 4,803,563)
  Ty21a-Sso wzz+, clone #9-26
atgtttttgcgcttccagaaccatacgcgccaggcgcgggtcgaccggcaactgggataattgtcggcccagcggcgtcagcttatatgccgtttgctgttcgtcggcggtaatcgcccccagctcttccaacaaacgcacgccatcctgaatattgcgcttatccggcgcttcgacaaacgggaaggcggctatgtcacccagtcccagggcggtcatctgcaaaataaccgacgccaggttggtacgtagaatttccgggtcggtaaattccgggcgtgacaaaaagtcatcttccgaatacagacgaatgcagatcccttccgatacgcgtccgcaacgccctttacgctgattggcggaagcctgtgagatcggttcaatcggcaggcgctgcactttagtgcggtagctgtagcggctgatgcgcgcagtgccaggatcgatcacatatttgatacccggcaccgtcagcgaggtttccgccacgttagtcgccagcacgatacggcgtccgctgtgcgactggaaaacgcggttctgttcgctgttcgacaagcgtgcatacagcggcaacacttcggtatgccgtaagttcagcttgttcagggcatcggcggtatcgcggatttcccgctctccgctcataaaaatcaggatatcgccaggactttcacgccccagttcatcaacagcgtcgaaaattgcctgtagctgatcgcgttcagtgtcgtcagcctcttccacgatggggcgataacgaacttctacgggatacgttcggccagagacttcgataatcggcgcgttattaaagtggcgcgagaagcgttccgggtcgatggtcgcagaggtaataatcactttcagatcggggcgacgcggcagaagctctttcagatagccgagcaagaagtcaatattcaggctgcgttcatgcgcttcatcaataatgatggtgtcgtactgcatcaatagcctgtcctgctggatttccgccagcaggataccgtccgtcatcagtttgaccatggtgttgctactgacatgatcgctgaaacgaactttatagccgatgcagccgccaggctccgtttgcaactcttcggcaatgcggttagcgacggtgcgcgccgccagacgacgcggttgagtatgtccaataagtcctttaattccgcgtcccagttccatacaaattttcggcaactgggtggttttaccggaaccggtttcccctgccacgatcaccacctgatgatcgcggaccgcttccagaatgtcctgtttcttctggctaacaggcagattttgcggataagtgattgaggggcgcgccgcttcgcggagagcgacctgcgtcgcagcctgttcaatttctttcgccatcgtctggaaaatggcctgttgcgcatcaggattttttactttctttacgccatgcaggcggcgcgaaaagcgctgtttgtcgcgcagcatcagtgcatccagccgctgctgtaacacctgaagcgtcaacgtagattgttcagtcataaagctcttgggcagcattctgcctgtttaaaatcgttttaaatgataggtatagagtaccacattggggctttttttgtgttgttcaataatttcgaacaaagggttcgatatattgcgctatccctgcgacatatttgtgaataaagtgtcaacaagcaacggggcacgccccttcaaacacataaaaggaaacacccatgagcaaggtattagttcttaaatccagtattctggcagggtactctcagtctggtcagttgactgactattttattgaacaatggcgcgaaaaacacgtcgcagatgaaattactgtccgcgatctggcggccaaccctgttccggtgctggatggcgagctggtgggcgcgatgcgtccgggcgatgcgcctttaacgccacgtcagcaggacgctctggcgctgtctgatgaactcattgctgaactgaaagcccacgacgtcatcgttattgcggcaccgatgtacaatttcaatatcccgacgcagctgaaaaactactttgatctgattgcccgcgccggtatcactttccgctataccgaaaaaggcccggaaggtctggtaaccggcaaacgcgcggtggttctctccagccgcggcggtatccataaagacaccccgacggatttgattgcgccttacctgaaagtgttccttggttttatcggtatcaccgacgtgaattttgtctttgccgaaggcatcgcctacgggccggaagtggcagctaaagcccaggccgatgcaaaagccgcgattgacagcgtcgtggccgcttaaatatttttgcctcccgtttcgacgggaggtgacttcttaggttcgtagcgcaaatatcctaccacgccgctactgccgccatcgctgggatgcgttaccccatcattgacttcaacgcaggcgaaatcaaaaggcgacacattttcaatgcacgccacattgaccccatattgatcgggattggatcggcgctgatgaaaagtatatatcccgcataccgaacagaaaaaatgcaccgccttgcccgtattgaagcgatattcggtaagcttatcctgcccttttagcactttaatacccgatagcggcgcagacactgccaccgctccgcgcatccggcaaaacgaacagttgcagcgcctggcggtatgaaagccatcgctaagttgaacggtaaacacgacgctgccacaatggcaggcagcagataatttttcagacgtcatacctggttactcacgcgaatagtgataccagtcgacagtatagaaatagccttccggttcgcctaatgtaaatacgacctccgtattcaaaaattacccatataaaaatgcattttgcggtaaaaaaattgtcgggaagcggttatttacgcatccatttgccattaattccctggacatattctcccggcctggcgcgcttaaccagtttttgccctgccatcttcgccacctcatccacgggaagatgattgctatccgctaactgctgataactggcgcgacgggcatgattgatatcaagcaccagcttctgggtttcggcatcattctttaaggccaccagatagccattcagcgtttccccgacccggccctgcgtgcgcgcttcgtccagggttaaggcccacacagaaggtgtgagcaagctcagcgtcagcacccatagtattaaatactttttcattatggcctcagaatagatcgctgcgtgatttcaggagttcttcaacgtctttatcgactttgatatgtatttcatgctcgatctttacattcatgttgatggtaatcggctgttccggcgcggcgacttcaatacgtggcgtgcaccccaccacgataaatgacgcaagcgctgacagcatggcaatactcattttcattatttatcctcacagtccttgtctttccggcaaggaggttgcggcaacgctgtattttgttcaagccatgcctgtaaattgtcgccaaaacgcaaactgcgccacagcgtaaacacattttcttcatgggtatagttcaagttaacgatcgcggttttaccatctacccggcttttgccggtaatggccgcctgcatcgttagtacgcccaggttatcaacgttaatttttgtccacgaatgcgtaatctccatataacgtagccagttaatcgccgagcctgccgtgacattatccttcaccaccgcatccgcagtatctttatcgatacgcaacgtcattgggcccaggattcgtaagccagccatctttgattatccatttttcattgttcagccacagcggcagcgcgccgctaaccggaccagacatggcgaattgctttggatttatggcgctaatcaattcgctggatgaaatattttgcacccgcaaaagcgccgggtcgtgctgcggcattcgcaactgtttcataataatttgaccgcccagcacgtctacgctgacatcgcttagcagtaatggattcgactcgctccagggataaccgccctgtaaatcggcggtgatatttttcgccgtgacctggttgactatcccggcaatacgcagcgagacgggcccgcgcgtccccaattgccacgcgccgttgtggaagcgaaatggcagaatgaaatcgacgccgttgattttgttatccggcatccaggcgctaccgccctttaacacgccgtgtccacctgcttcaaatccctgcccctgcgcagcggaaaaagccacctgcgcatacagtgagccttcgcgcagcgtcattttccagtccggtggaagcaacggctggaaaacgataagcgactgcttcggccaccaggcctgtccgcgaaggcgttcgccatcccagcgcccgttcagccgtaccggccctatcgcccccgcccgaaggtcgcctttaaactggaacagggttggctcgcgcccttcaacgctaaaattaagggtagaaggcggcagcacgctcccgctggtaaatacggtttttcccgcctccagagacagcgcgccctgtagcgacggcgttgtggcgtcgcgaacccagacaataggtttatccagcgccagtcttggcgatgtgacggtcattgcgccatagtgcaactgatcaaaaccggtggacaaactggtcaacctgatggtgttatcatgccattcgccctgtccggcaatatcccagcgggcgcgcattggcgtaaagcttccttgcccccaatagcgccaccgccagcgaccagcatcagggagaaaatcattggccaggccatcaagatgaagaacgaaatcgcccatctcattttcgtgcgcccgtaaaatagcctgtaatcgaccatcaacgccgcgcggcgttaccttaacgcccgccagcggccaacgaatttcatcaatatctaacgcatcaatcacccgtccgcgtgagcgtagcaatgcgccaggtgcaaaggtgagctgcggatcggccagactgccgcggaacatagcgggcaatacggcataaaagattaaatccttctgtttagcctcgccggtaagctgtagaggcatctcactgctatccatgctgagttttcccgggccgatagtcagtaccgcgttcgctttaccggcatcgccctgggtcagaatattcaggcgtccgctgactcgcgcattatccggcccggcttgccagttatcgatattaaaagccagacgtccgctcaaggggaatccctgatatggccagttccagcggccatcgctgacggtaagccgctgacgcgttaccgcccaggggagatcgagaatcggatcaggattacctcgcgccatcacgatgagctgtccggcattatcacgccactccagttccgcatccaccagcgacggttcctgcggcagacgcaaggtcgctgccgcatgaccgctgaccggcaggccatccggtaccagcggcaacataaactcccccgccaggctaacgggaggctggttggccagcgcggcgatctccagttggctcaccgtcaatgcctgaccgcgtagctgcccttgaaattttactttttcgccctgataacgtatctgctgaatgaccggcgtcatggagatcgccagcttgccctgccattccggccagggcgcgagaatgacattatcgatgttaatccaggtattgggcagcattgactgccactgcgccagcgtacgcggcgcggcgggagaagcttccgaagccggcagtttcgccaggcatgcggcatccagtttgaggcttttaatattcagcaaccaacggctgggatgcgtcagttccgcctgggtaatatgcgctaacgaacaatcattgaccagatagcgaagatcgggaatcactaacccatgacgtgtcaggcgtggactttgttccagagcgatacgggtaccgacgggtagccaaattcccgccagagtgggaacccacagcccgagggtcatcagtagcgtcagagggacaagaatcagcagtaacagtagcgcaagggcggctttatatttacccttcatgggccattaatttcctgatttaacgaaaaattcagtcggctatctctttattttggcatgattgcccgtacatagcctaatagttcatgttgcaaacgggtgatacgttatgcgtgttgcagggccgccctccgactatttgaggcgtcgtggagaatgataacctaaaattattcatcatatgtatgactatcaattatttttgattttttgtaagataattttaagcatatttgtgtgattctaacatcactggagaaggtcatatgaaactcgccgtctatagtaccaaacagtatgacaagaaatatctacagcaagtgaacgaagcgttcggttttgaactggagttttttgattttctgctaaccgagaaaacggcgaaaaccgccaatggatgtgaagcagtttgtatcttcgtgaatgacgacgggagccgaccggtactggaagagctgaaaaaacacggcgtgaaatacatcgcgctgcgttgcgccggatttaataatgtcgacctggatgccgctaaagaactcggcttgcaggtggtgcgcgtaccggcttattctccggaagccgtcgctgaacatgcgattggcatgatgatgacattgaaccgccgtattcaccgcgcttatcaacgcacccgcgacgctaacttttcccttgagggactgaccggctttaccatgcacggaaaaaccgctggcgtcattggtaccggtaaaatcggcgtcgccgcgctgcgtatcctgaaaggctttggaatgcgtttactggcgtttgatccctatcccagcactgccgcgcttgacctcggcgtcgagtatgtggatctgcaaacgttgtttgccgaatcggatgtcatttccctgcactgcccgctcacgccggaaaactaccatttactgaaccatgcggcattcgatcaaatgaaaaatggcgttatgatcattaataccagtcgtggcgcgctgattgattcccaggcggctatcgaagctctgaagaatcagaaaatcggctcgctggggatggatgtgtatgaaaacgaacgcgacctgttctttgaggacaagtcaaacgatgttattcaggatgatgttttccgccgtctgtcggcctgccataacgtactgtttacggggtatcaggcattcctgaccgcagaagcgctgatcagcatctctgaaaccacgttacaaaacttaagccagcttgagaagggcgaagcctgcccgaacgcgctgttctaatcctgtcgctcccctgcgctcagaggagcattttcggataacccctgaagatctatccggtcatatcattactatagtcagtgttaactatcagattacagagaatatcaatgaagaaaatcgtcacgctggtcgccctgagcatcataatgacagggtgtgtgagcagtggaaaagtgtccgtcaaacgcgagcaactggagcaccaccgctttgttctggaaagcgtaaacggtaaaacggtcaccggcccggagctcagctttggcgaggacatgacggtatccggcaaaatgtgcaatcaattcaccggcgaaggaaaactatcggacggcgaattaaaagtgaaaaatttagcgatgacccgaatgatgtgcgccgatccgcagcttaatgcgctggacggcaccctcagcgagctcttcagcaaaggagcgcaagtcgatttaactgcgaaccaattaacgctggcgacggcagaaacaacgctaatgtataaactggcggatttagcgcactaagccattaagtgaaaagttatacgcgtcaggcgaaacgccgcgcttaataactcccgcagcttccggcggcaagcgactgttcgctacaacgtttgccgttgggtagcgcgcacataccaattactgaaccatcaagctgccgggccgctgaaagcgaaccgccaatcatagcgcaattcgcttcgccggcgctggacatcgccgctttcatccctggcgaaacatgcgccgcagttgcctgctgaacaggttcgctactgcaagccgacaataataacgcggcacatcccacccaaaacgctgcgcgcatttctctcccctctgtttattcatccaaacgacaccgccctaaataataggcagcagaaactgacgcgtcgagaggcaaagcgcgcatttatgcgcttcattaacatttattggcaattttttacgtcttttcggcaagaaatcgccattctcctcccgccagggacacaaaagcgaaaatggggcttgaagggctttgctaaaataaaaggataactacaggatacgctcacgattatgcgtgtccctcttttttgcgcaatgtaagggtgtcatatgcaaacgattgacggtaatggcgcagtagcgtcggtggcgttccgtaccagcgaggttatcgccatttacccgattacgcccagttcaacaatggctgaacaagcggatgcctgggccggcaatgggcttaaaaatgtctggggcgatacgccgcgtgtggtagagatgcagtcggaaggcggtgcgatcgccgccgttcacggtgcgttacaaaccggttcgctttctacgtcatttacatcatcgcaggggctgctgctgatgatcccaacgctgtataaactggcggggcagctcacgccgtttgtactgcacgttgccgcacgcaccgtcgccacacacgcgctttctatttttggcgaccattccgatgtgatggcggtccgccagacaggctgcgcgatgttatgcgccgccagcgttcaggaagcgcaggattttgcgctgatcgcgcacagggctacgctgaaaagccgcgttccgtttattcatttttttgatggcttccgtacatcgcatgaaatcaacaaaattataccgctaacggatgaaaccattctgaacctgatgccgcaggcggagatcgacgctcaccgcgcccgcgcgctgaatccggagcatccggtgattcgtggaacttctgcgaatccggatacctacttccagtctcgcgaagcgaccaacccgtggtacaacgccgtttatgatcatgttgaagaggcgatgaaggcatttggcgatgctacaggccgccagtaccagccatttgaatattatggtcatccccaggctgaacgggtcatcattatgatgggctccgccctcggcacctgcgaagaggtcgtggacgagctactgatacgcggagaaaaggtcggcgttctgaaagtccgtctgttccgccccttctccgccaaacatttgttacaagcattaccggaaaccgttcgcgctatcgccgtgctggatcgcaccaaagagcctggcgcccaggccgagccgctttatctggacgtgatgaccgcactggcggaagcctttaataatggcgagcgcgaaacattgccgcgcaccattggcggccgttatgggctatcatccaaagagttcggcccggcgtgcgtactggcggtctttaatgaactcagccgcgcgaaacccaagccacggtttacggtgggcatttatgatgacgtcactaatctctcgctgccattaccggaaaataccctgcccggcagcgctaaactggaagcgttattttacggtctgggaagcgacggcagcgtatccgccacgaaaaataatattaaaattatcggtaattctacgccgtggtatgcgcaaggttatttcgtttatgactctaaaaaagctggcggactcacggtatcgcacctgcgcgtcagcgaaaaacccattcgttccgcttacttaattgctcaggcggattttgtcggctgccatcaattacagtttatcgataaatatcagatggcggagcgtctgaagccaggcggtatctttctgcttaatacgccgtacagcgccgacgaggtctggtcgcgtctgccgcaagaagttcaggcggtattgaatcagaaaaaggcgcgtttttacgtggtcaacgcggcgaaaatcgcccgcgaatgtggactgggcgcccgcatcaataccgtcatgcaaatggcgttcttccacctgacgcatattcttccgggcgatagcgctctggttgagctgcagggcgcgattgccaaaagctatagcagcaaaggtcaggatctggttgagcgtaactggcaggcattggctctggcgcaggaatcgctggcggaagtgccgttgcaggcggttaatccacacagcgcgcatcgcccgccggtcgtctccgacgccgcgccggatttcgtgaaaaccgttaccgccgccatgttggcgggcctcggcgacgcactgcctgtttccgcgctgccgccggacggaacatggccaatgggcaccacccgctgggaaaaacgcaatatcgccgaagagattcctgtctggaaagaggaactgtgtacacaatgtaatcactgcgtcgccgcctgccctcactcggcgattcgtgcgaaagtcgtttccccgcaggcgatggagaacgcgccagccagtctgcattcgctggacgtgaagtcccgcgatatgcgcggccagaaatatgtgctgcaggtcgcgccggaagactgtactggctgtaatttatgcgtagaggtctgcccggctaaagatcggcaaaatccacagatcaaggcgattaacatgatgtcgcgccttgagcatgtggaagaagagaaagtgaattatgacttcttcctcgacttgccggaaatcgatcgcagcaaactggaacggattgatatccgcacatcgcagctcattacgccgctgtttgaatattccggcgcctgttccggctgcggtgaaacgccgtatattaaactgctgactcagttatatggcgacagaatgttaatcgctaacgccacggggtgttcctctatttacggcggtaacttaccctctacgccttataccaccgatgccaacggacgcggcccggcgtggacgaattcgctatttgaagataacgcggaatttggcctcggtttccgtctgagtgtggatcagcaccgggcgcgcgtcatgcgtttactggcgcaattcgccgatcgcattccggcggaattaaacgatgcgctgcatgccgaagcaacgcctgacgttcggcgtgaacaggtcgccgcattacgccaacatctgaaatcggttgcgggcgcagaggaactgttaaaaaatgctgatgcgctggtagaaaaatcaatctggctgattggcggcgatggttgggcatacgacatcggctttggcggtttagaccatgtgttaagcctgacggagaatgtcaatattctggttctggatacgcagtgttattccaatactggcggccaggcgtcgaaggcgacgccgcttggcgccgtcactaagtttggcgaacatggcaagcgtaaagcccgtaaagatcttggcgtcagcatgatgatgtatggtcatgtttatgtcgcgcaaatttcgctgggcgcgcagttaaaccagacggtgaaagccatccaggaggccgaagcctggccaggaccgtcgctgatcattgcctatagtccctgtgaggaacatggctacgatctggcgctaagccatgaccagatgcgccagttaacggcgaccggtttctggccgttataccgctttgatccccgccgtgcggatgaaggcaagccgccgctggcgctggactctcggccaccgtctgatgccctagcggaaacgttgcttaatgaacagcgtttccgtcgcctgaatgcgcaacagcctgaagtagctgaacaattatggcgagatgccgcattggatttgcaaaaacgctatgactttcttgccttgctggcaggaaaagcggaaaaacccagcgcagattaaaaaacattctaaggattaacctggaaataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaagcccgaacatccgttcgggcttgtcaatttatacgctggaaagcaaaggttaacgcaatggcccaacgacaaaatgaatatgtgacaataaaggcatataacaggcgtagaatatcgtaaccgaatgatattgtataatttttatttcgtataatacccctaaaagcattcgtataaattatatctatttcactgcgaattatttcattaattattgaattaaacggtaacatctctttttaggtctttcctgacaaggcagaaataacgttttaacgtcaactcgctgattatttacggggaatgcgcttaatattacgccgtcctcccctgttggtagtccccccagagtatcgtggagcagcacctaaaatgtgacgtatgtcattgtacataaagtgcctttagggagtagaatttcagtggatacttaaacaggaggttttatgaacagaacgattcttgtacccatcgatatttcagattcagaattaactcaacgcgtgatttcacatgttgaagccgaagcaaagattgacgacgctaaagtgcactttttgactgtaatcccgtctttgccctattacgcttcactgggactggcttattcagcagagctccccgcaatggacgatttgaaagccgaagccaaatctcaactggaagcgattatcaagaaattcaaccttcccgcggaccgcgtgcaggcgcacgtggcagaaggctctcctaaagataagattctggaaatggcaaaaaaattaccggccgatatggtgattatcgcctcgcatcgtccggatattactacctatctgttgggttccaacgccgcagccgttgtgcgtcatgcggaatgctccgtactggtggtgcgctaaatacccgagcccgcataagagagtgcgggctcaaatcaaccatcatcatcgcctagtgactgacgctttttgaaaacagattgattacgattacaccgcagatgataagcaacatgccaataatagccggcacatccaatttttggccaagaaacagccatcctatcaatccaataagaacaatccctaccccagaccaaatggcataaatgatacccgcagggatggttcgcatagggatggtaaggcaccagaacgcgatacaatatccgatgatggtaacgaggctcggtaccagacgcgtaaaactatccgataattttaatgagatcgtggcgataacttctaccacgatggcgataaatagaaagattacagcttctttagtcatacatctcttcgttccgatatttttctggtcgtggtgacatcttaattaatacggatgacagaataaagacgcttttgacccgttgcgtatctcgccataacctacttcaagttgcatgtgctgcggctgcgttcccttaccccagtcacttacttgagtaagctcctggggattcgctcgcttgccgccttcctgcaactcgaattaattaaagtataaaagcaacctttcatacacgagagataacaacaataaacctgttcaggatttatgattacttagaagcgtttgcctgccccgtattttctgctttaccatatgtcctgtcaattataccaacagggtccactggtgtgttttttggcataacccagccactttcactgacactacctcgtgtaagatatttgacttttaccctaacgataataagataatgttccctgctgaacctgtcggcaacactaagatcggtggtatattcaggtacgattcttccacttcgaacctgctctttggctatttcagcagagacaggcaatacctctacatcgccccctcaataccgcctgctgttttaaaactaacaatattttcagcctgcggacctattgtacctcggcataatacaacttcagtctcccctgctacagcatccccactctggtatttcttataaatactttgtacattttcttctgatgtagggtataaattttctgacagagaggccagtatatcttccagtaagggggaatcatccgtaatatccagaagctcttcatcataacccgtgtctccttctcttaactctgaataaggcttatcaatatggcgaataagccccccacctttcagccctgacgcctgataaaatcttccatcagaagatcggtaaaatgttatggctgaattttttccgctatccgaataggttgcctgatacgtttctgaaccgggttctttagttaaaacgagctctctgtcgccatattttatcgtattaggcgcttccgatgacagcggtggatatgaggcttgttttctgtagcgtccccctgccatagatgtaacgtgttcaaataggccatctaacaccttacctgccaggttaggctccgtagttggggcaggatgatcctccgggagagccctttcatatctctgtaattctttaacaggtaaaaaatcattctcaccctctgaattaccattttttatcctataatcaccagatgttactgctaatcttgatgataataacaaaccagttactgcaatgtttttaatactcctgtccattttatgaatggttactggctgaagatgattgcggctatgagaagataagaaaatttgcttttgaatttcctttccctcaaatataatttgctcagtgcttttaggtggaacagttacgctatctacattaaatagctcatgttcaccactcatcgttacctgagaaaaacacgacgatgtatgtgcaattgcagcgggatcaatctctttataaataacattggcgtaaacgtttgcaacttcaccgcttgcatttaaatgatcgtgcaaaatatgttttagaaatagatctaacaacattttttttgatgtgattccatttacacagttgtgaaagtcagggggaattggatagccgttttgatcaaatggaagcgataaacatcctcgccccccatcaatattttcgtaactgtaatttagagatatctttacctcgcatttattggtatctacatcgtcattgatactgcgctctactttataattaaccagcctacggaaggttgcgctatttgaataataaaaatccaatgttgattggatttcttcacatataatttcatgtgttggctcaaagaagaattcataaatatttaagctgttcttttcttcatctttggccatctcatccagcttaatatattcttctggtaaattagatatttgctcatgaaagatatcgtcctgataaagtccatccaacattgaaaggtacggtatggtatcccaacttctgatagcttgtatctgtaccgtctgctgtgattctctggttgatatatcacttactgttatacgcattacattctccagccagaattatggtatacatcataaggtgtagatatcaggtagcaattctcatcgcaaataatttgtctgaactgtacatatgatacaggctatttttaattcaatatgaccaccagaataggcaagaaaattttaaatagtatacggtaaaatgatcttacccaacgataattaaacacactgcactatcttattagataataaaatactgatacgttattttatatcaccaataaaagagcaaaaagggtgtgccgaatatcattttacacctgtcccggttcaccccacggaaccacttgaaacgtaccatcatcaggacgctgcagcgcctgaatttcagttgagcccgtcacttcttaacgggcctagctacatgatgtatacagttgacaatatccgaaggtactatctctattaaaacgtgctggcattcgtcgccgtaatccgtaccatacgcgacatacttttgcctgctggctgttgacggcaggagcgaacccggcatttatcgccagccaaatggggcatgaaactgcgcatatggtgtatgaaatttacggtatgtagattgatgacatgaacgacgaacaagtagcgatgttgaatgcgcggttatcgtagttgcaaagtttgcccccaatttgccccatttagtaccagagaactgaaataatgcaagaaattcaaaagaatacaaagaaagaacaatacaacctcaacaagttgcaaaagcgcctgcgccgtaacgttggcgaagcgattgccgattttaatatgattgaagaaggcgatcgcattatggtttgcctttctggcggcaaagatagctatacgatgctggaaattttacgtaatttgcagcaaagcgccccgatcaatttttcactggtcgccgtcaacctcgatcaaaagcagccaggttttccggagcatatcctgccagcctaccttgagcagctgggcgtagaatataaaatcgtcgaagaaaacacctacggcattgtgaaagagaagattccggaaggaaaaaccacctgctcgctgtgctcgcgtttgcgtcggggtatcctgtatcgtactgcgactgaactgggcgcgaccaaaatcgccctgggccaccatcgcgacgatattctgcaaaccctgtttctgaatatgttctatggcggaaaaatgaaagggatgccgccgaagctgatgagcgatgacggcaaacatatcgtgatccgcccgctggcttactgccgcgagaaagatattgtccgttttgctgaggccaaagcctttcctatcattccttgtaatctgtgcggttcgcaacccaacctgcaacgccaggtgattgccgacatgctacgcgactgggataagcgctatcctggacggatcgagacgatgtttagcgccatgcagaatgtcgtgccgtctcacctttgtgacacaaacctgttcgatttcaaagggataactcacggttccgaggtcatcgacggcggtgatttagcgttcgatcgtgaagagattccattgcagcccgctggctggcagccggaagaagatgacaccgccttagaggcgttgcggcttgatgttatcgaagtgaaataatctgcaggcgtctcagcactccgctgagacgccatactatcgatcattttaatagccgtacccggcatgacttgcctttgatcttcccgttttgcaactgcttccaggctttttgcgctactgcttgacgtacggcgacgtaaacgtgcatgggatgcacgttaattttgccaatatccgccccgtccaatccaatatcgccggtcagcgcgcctaaaatatctcccggacgcattttcgcttttttgccgccgtcaatgcatagggtagccatctctgcggccagagggagtaacggctgccgggcgggcgcattcagccagttcagcttgagttgcagcatttctgaaagaatattcgcccgctgcgcctcttccggcgcacagaaactgatcgccaggccgctgcttcccgcgcgcgccgtacggccaatacgatggacatgcacctccgggtcccaggccagctcatagttaaccaccagttcgagcgatttaatgtctaaccctcgcgcggcaacgtcggtggcaaccagaatgcgcgcgctgccatttgcaaaacgcaccaacgtctggtcgcggtcgcgttgttccagatcgccgtggagcgccaacgcgctttgtcctaccgcattaagcgcatcacaaacggcctgacaatcttttttggtattgcaaaacaccacgcaggacgctggctgatgctggctaagcaacgtttgtagcagcgaaattttttcatgcgccgacgtttcgaagaactgctgttcgatagccggtagcgcatctaccgtatcgatttcaatacgtattggctgctgctgtacacgaccgctaatcgccgcaatggcctcaggccaggttgctgaaaacaacaacgtctggcgcgtcgcaggcgcaaagcggatcacctcatcaatggcgtcactgaatcccatgtccagcattcggtctgcttcatccattaccagaatgtgcagcgcatccagcgatacggtttctttttgtaaatgatccagcaggcgccccggcgtcgcgacaatgatatgcggagcgtgctgaagcgagtcgcgctgtgcgccaaagggctgcccgccacacaaggtcagaattttggtatttggcagaaaacgggccaggcgacgtaactccccggctacctgatccgccagctcccgcgtcgggcacagcactaatgcctgtgtctggaacagagtgacatcaattcgatgcaagagcccaagaccaaacgccgccgttttaccgctaccggtcctggccttgcacacgcacatcattacccgccagaatgacgggtaatgctgcggcctggacaggcgtcatctcaagatagcccagctcagtaaggttattgagctgggcggcgggcaaaacattcagggttgaaaaagcggtcacaatttactctcgcggtaacgactcatagtcagcaggcgcgtatcctcgcagatccggacgtttgatgcgacattttaatcggttcttcgtccggcggcgggtcgggcatcggctgaggacggggaagcggctcaggaatgggaacagggtcagtgggaatcgggtccgacaaggacgagtgtagatataataaggtcaaaagacagctcatattaccctccagaatgtcattcagactcttaaagggtagacgctgatatcctacaggcaaaaaaaagccgactaatctaagccggcgtcgtacgaatcaattgtgctatgcagtaattcaaaaaaggaagcaagacaatatagaacgcaacgcccatcgcttgacgttgcattcacctgcgagagagatattgccccgaataggtagatggtttattgacttcgctcaaatttctcggcgttttttcacccaaaacggtctgaaaagcgcttttgttacaaccatttactgcgatgcaaccataaagtaacaccaccgatcaggacaactaacagaatacaaaacagagaaaagccgaaccgccatccgccgccaggaataccgcccaggttaacgccaaataaccccgtgaagaaggtgctgggcagaaaaaccatcgccataagcgacatggtataagttctgcgcgccagagactcctgcatcacctgggcaatttcatccgccatgatgccagtacgcgcgatacaagcgtcaatttcatccagcccccttcccagcctgtcggcgatatcctgcattctgcgccggtgatcgtcgctcatccacggcagccgttcactcgcaagccgggcatagacgtcgcgctgcggcgccatatagcggcgcataacaattagctgtttacgtagcaacgcgaggaaaccgcgcggtgggatttgctggtcgagaagattatcttccagatcgataattttatcgtgtagctcttcaataaattcactggcgtgatcggttaacgcatcgcatacatccactaaccagccgccgcaatctacgggcccggtgccctcctgcaaatcactgaccacatcgtccagcgccagaacctttcgctgacgggtagacacaatgaaccgctcgtccatatataaacgcattgctactaattgatccgggcgttcgtcagtactgccattaatacagcgcagcgtaatgagcgtcccttcccccatacgacttacgcgcgggcgcgagctttcaccagccagcgcatcacgcacgttattggggagtaaaggcgttgaagccaaccagcgggcgctgtccgggtgggtataattaagatgtagccaacagggatgctgactatcgatcacatcattatcttcgagcggttttactccaccacgaccatccagtagccatgcgaaaacggcatccggcacgttcacatccgatcccttaatggcttccacagcgcctccacgttacaactctcatgccgttagtctagctttcgggaaaggttaagcaatctctcattttctcattgcgcaaaaagaatgacgggaacgtgcgaaaaaagcgccttagcaacaggcgcttaccaaacatgtattatcaggcctggccgcgcctggtgatggtcgaaagaggtgatacatgagagcgcgacagcgcatgttcactgtaacccggctggcttaaacgaaatttgtcggttttagtctgtaactcgatcacctgcgcctttaaaacatccgaagaagcagatagcgcttcaaccattaagacattgctatgggttgcgctttccagatcgctcaacgccagggttatctggttaatgcctttttcctgctcccgcgtggtggtggaaatttcactcatcagcacgtttaattgcccggagccgccaacaatctcctgcatatttttttcagcctcctgcactatggcggccccctgccgcacattgtcatgcgtaacgtcgatcagcgccttgatattttttgccgcctcagcgctacgatgcgccagattacgcacttccctggccaccacggagaaaccttttccatgatcgcccgcccgcgcagcctctaccgccgcgttaagcgccagaatattagtctggaatgcgataccgtcaatcaatgaaataatctccgtcatctgcgaggcacagtcggtaatagaacgcatattttctgtaacccgcaccattaactcaccgcctttacgggcgcattgggttgcacaatccgcctgtatgctcgccattcgggtattatccgcattgtttttggtactcgccgccatttcatccatactggcggcagtttgaattaacgaggccgactgctgttccgtctttacggatagcgacagactgcgcgccgccagttgttcggaaagggtcattgccgtttgcgaagaggatctgatttcacgtaccagcgcggaaatattctccgacaggctattaatcccggggatgagtcgcccggcgcaattattgccaaattcggagatatgaatagacaagtttcctgctgcgacctcttcaatacttttcttcgcggtattaattggcactaccagatagcaggtcatataccaccaaagcagtaatgccgagatcagataaatgatattacacgtaattaaaatagggagatcgtgcagaaaggttatttgtaaagtatccactaaaagaaacgtacataccatgaatagaataatgcatgtcctgacgctgatatttctcaacatttttgacggcctacaaccaggataggagacaggttttatttttatagcatttcagatacctattgccattcgtttctttgacattctccatattcaataccagaccatcgccatttcccttagtgcaatagataaaatcatctatattcgctatgccaggatattcatccatccatattgacaagtgatgtacttatcaccattttctgcttaatagttaagtcgaaagccagtatattttaatagacgcttaaataagtgaatgactgtttctccgtgttattactgtggacagcgttatcgcccgttctcttgcagaatcctgagcgtttggatgaggcgttatatcaggcataaaatcgggttcatgcgagcttgcgctggcggtcctgtccgccagcggcaacgatttaccgactacgcttcgcatggcgctcccagttatcctgtttagcctgcaccgttttacgtaaagcgacataacatgccccgccgccgccatggtgcggcagcgccgaacaataagcctgtacatcctcaaactctgtcaaccagcgggccacatagcttcggacgatattggcatgcgacttcgcctctcgccctttaccatgaatgatcaggacattacgcaacccctctttctgcgcctccaggataaaacgaaacagcatttttcggcacgtttcgaccggttggcgtaacaaattgaggctggcctgctgagggtatttcccactgcgtaacttgtcgatgacaccctgctgcaatccttcccgacgaaattccagcggttcattcagcggcagaatatccagaaagcccgtcgtcaggaaattatcaagctgaagcgtgtcgatacgctggggcgttttaagattacgcgttggctgccagtgtacatcagtatggcgtttcagcggctggacatcctccatgacgtcaagaaacagcgctttatcgtcaaggttcatggttcatcctccagcgtttttgcgactgccgttatcataaccgtgccctgttataccgacaacggtttacagttatttccaataacagcgacaatgtcaggcaattaaccgtctcgccaggctccctttttctccgccaacgatattactgtcgctaaatgtgttatccctgactatcttttaaggagtatggttgcgggtattcctggcatgatatcttgtctcttacgttagattaagacgatgtgagagaacggatgctgagattacttgaagagaagatagccacgccattaggtccgttatgggtggtttgcgatgagcagtttcgactgcgggccattgagtgggaacagtaccgcgatcgtatggagcaactgctaaatatccactaccgtcacgaaggctatgaacgcgtttctgcgactaaccccggtggactcagcgataagcttgcagattattttgcaggcaatctcgccgtaattgataccttggaaaccgccacggggggcacaccttttcaacgggaagtatggcaggcgttgcgcgctatcccctgcgggcaagtgatgcactatggccaactggcggcgcaactgggacgaccgggcgccgcacgcgcagtgggtgctgcgaatggcgctaaccccatcagtattgttgttccctgccatcgcgtcatcgggcgtaacggcactctgaccggatacgcaggcggcgtgcagcgaaaagagtggctattacgccatgaaggctatcttttattatgaatatacaggcaaaaagtgccttatcggtcacacttttatgtaaagtagcaacaaataaattacgtattttcaaatagatataagtattcatcaaacttatacttgaattattccttctccgggatagctcagacttacgcgctcaccaaaaagatgttaaaattgacaaatatcaattacggcttgagcagacctatgatcccggaaaagcgaattatacggcgcattcagtctggcggttgtgctatccattgccaggattgcagtatcagccagctttgcatcccgttcacacttaacgagcatgagcttgatcagcttgataatatcatcgagcgcaaaaagcccattcagaaagggcaaactctgtttaaagcaggtgatgaactgaaatcgctctatgctatccgctccggaacgattaagagctacaccattaccgagcaaggcgatgagcagattactggattccatttagcaggcgacctggtgggttttgacgccattggcagcggtcatcatccgagctttgcacaggcgctggaaacctcaatggtatgtaaaatcccctttgagacactggatgacctgtccggcaaaatgcctaacctgcgtcagcaaatgatgcgtctgatgagcggtgaaattaaaggcgatcaggatatgatcctgttattgtcgaagaaaaacgccgaagaacgtctggctgcgtttatttacaacctgtcccgccgctttgcgcagcgtggtttttcaccgcgtgaattccgcctgacgatgacccgtggcgatatcggcaactatcttggcttaacggtcgaaaccattagccgtctgctggggcgtttccagaaaagcggtatgctggcggtgaaaggtaagtatattactattgaaaacagcgatgcgctggcggccctcgccggtcatacccgcaacgtcgcttaaacgtcagctaaaccattgatgttatcttctgccatatcgttaaatttttctcatttattgatctggcagaagcgcttcccctgtttcattcaccatatttgagttactctttagttacaaactgcgatgacagttgtaaggagaccctgtatggctatgtatcaaaatatgctggtggtcatcgatcccaatcaggacgaccaacccgcattacggcgagcagtttatttgcatcaacggattggcggcaaaattaaagctttcctgcctatttacgatttctcgtatgagatgaccaccctgctttctcctgacgaacgcaccgcaatgcgtcagggcgtaataagtcaacgcacagcctggatacgtgagcaggcgaaatattatcttgaagccggtgtccccattgaaataaaagtggtctggcacaatcgtccctttgaggtcatcatccaggaggttatcgccggcagtcacgatctggtgttgaaaatggcgcatcagcacgatcgactggaagcggtcatttttacccctaccgactggcatttgctgcgtaaatgcccaagccccgtgtggatggtcaaagatcagccgtggccagagggcggcaaagccctggtcgccgtgaacctggcaagcgaagagccctatcacaatgctctcaacgaaaagctggtaaaagagaccttacaattggcggagcaggttaatcataccgaagtacacctggtcggcgcctaccccgttacgccaatcaatatcgccattgaactgccggaatttgatcccagcgtgtataacgacgccatcagaggccagcatttactggcgatgaaagcgctgcgccagaaattcagcatcgatgaaaaagttacgcatgtagaaaaaggcttgccggaagaagttatcccggatcttgccgaacatctccaggcggggatcgttgtgcttggcaccgttggacgtaccggactctcggccgcgtttttggggaacacggccgaacaggtcattgaccatctgcgctgcgacctgttagtcattaagcctgatgagtatcaaacaccggttgaactggacgacgaggacgattaatccctcttccgtcctgccggatggcgctgccatccggccaacacctcattcctgttactcatctccgccgaggaaatagatccccaaaggaatcgccagcagaatagtgaacaccagactgtaaacgaaaatcattgccgactgaatggcatacatagagcttgtccactcggacagtggaatatgatattgctcaatcacaccgccgatagtcgcgcgcgttaccaccgatgccgcaacgataaacactgccagcaggcataacagaaattttttccccttcgccgatttcagcttcatcatgatcatagtattgtcctttacagatgactttgttacctgatagcaacaataccatgacaatcacgcgatgtctgctccataaaacgtaacattgtatttacataaaaagtaaaccgctgagattaaagctgatagcactatttcttctttttacttatcgatgatctacgcgtttatcctgggtaaaatacctgttaatcaggtcattctgagctgttatcgtaggaaggagcggaaaacaataatgttcactgaattttttctcaaaaacgcatttaatctggcgatacttttcagttgcggtatggcgttgctggtcgtgagattttggctcagccgtaacgtacagtggaagaaaggattcacgttccatgcggcacagttttttatttacgcgattattattggaaccatcgggagcatcctgaataatgctattgaagattataatttgcgttttatctcttccggggtcattgattttatctgcacctcgctcattgcgcttattctgacgataaaacttttcctgattattaaccaatttgaaaaagcacaggtcaataaaggtagagatgtcaccagtacccgtattctggcacgggtcataaaaataaccattattgtcgcgattgtcttactgtatggcgaacattttggcatgagtctgtccggtctgctgacctttggcggtatcggcggtatcgctgttggtatggcgggcaaagatgtcctgagcaattttttctccggtattatgctctatttcgatcgccccttcagtatcggagactggattcgttctcctgacagaaatatcgaaggtacggtcgccgaaatcggctggcgaattacacgaattaacacattcgaccaccgcccgttgtacgtgcctaattccgtcttttcatccattagcgttgagaatccgggacggatgaccaaccgtcgaataaaaacggttattggattacgttacgaagatgccgacaaaattggcctcattgttgacgctatcagaaacatgctgcaggcgcacagcgatatcgatcagaaacagacgctgttggtctattttaatgaattcgccgactcttcgctgaatattatggtgtattgctttaccaaaacaacaatatggcaggaatggcttgctgtacagcaggatgtttacctgaaaattattgcgattgtccaggaaaacggcgctgacttcgccttcccaagccagacgctatatatcgatgacccggaggccgcgcctgcgataaaataaaagatagccggtgcccgataacgcttatcgggcaccgaggcttccctgtccggatgacgggttgttagcgccttccttacggtgatcaacggctcttttcattcaccgtcatggtaaattcaagcacctcattagtgtcgttaacgtaggcatgaggcatatcggttctggctacagcggagcagccctcccgaataataaagcgtctaccgtcgactgttaatgtcagtgttccctgattaacaaacagtaattcacaggtgtctgccggatgccctgccgactcaaactgttcaccaggatgcattatccattgccatagttccagcatatccggcccgctggttcccgccattagttttgcactgccgcctttctcgccgcgccacaacaccggaatagcatcccggttgataagatgaaccatcggctcgctggcgacgttgacaaaatccgccacggacactcccattgccgccgcgatcttacataacagcgcaatgcttggattagctttacagccttcaatttccaccagcattcctttactgacgccggaacgccgcgcaagctcatccagcgacatctttttttggctacgaaattgtttgatacgttgggaaacagcttcatttattgtgctgacgtcggcgcccgccgtggtcgataagttgacttttttggtcattggtcgatatcatagaataaaatagtcattacaggattatgcgatgtcttctatgttaccgtcaatcagcccggaactggcccgtatcgctcccggctttcgtgcattaagtattaatgttattgccgctccggttcgcgatgcgcaggtcggagaaatcgcgttaaaagaggcctgtcaggccgtaattaacggacaaccggcgtgggcacaggcgcatatagacgcctggaatgcggtgtttaaagcattcggcgcaaaaccaaagcgcaccccctgctcggctgaagcgctacgaaaacgcgtgttgaaggatggaacaatggcggcgctggacccggtcgttgatctttataacgcggtgagcctgcgctatgccgtgccggtaggcggcgaaaatagcgcggcttattgtggatcgccgcggctggttttcgcagacggtagtgaaacatttgataccctgaaagaaggaaaacccgttaccgagtcgccagaaccaggcgaagttatctggcgcgatgacagaggcgtcacctgtcggcgctggaactggcgtcagggagtacgtacccgactaagcgcttcagataaaatgatgtggtttatccttgaaagcttgccggaaatgccggttgatgaattgtacgcggcagaaaacatgctgactgacggccttgaaaaaatgatgccaggtttacgttttgaatccacgttgataggtgtttgattgatattgcgtaacaggagaaataccatgtcgctgtttctgacaagttttattttcgaaaaaaaagagtacgacgaagagttttatcaactggatggctggattgagcgctatacacagactattgatggctatattgggatggaaagctataccgatgccgccagcggaagaatggttaataattattactggcagacccgcgaatcaatggagctattgataaataatttacagcaccagcaggccaaatcacaaagtcataagtggctttccggttaccagacgattattgcagaaattcaggggtgccataacgttaacctgccccatccgctggcatcattttcagttccctatgcgtgatgcaatagtatatgtattaaatgtgggggcacacaggagaatgcctgcgcccctgcattgccagttattcggttttctgtgcaggggcggcgctgatataagtgattaatagacaggaagatgagtgatatctcgtggtacactaacatgcgtaaccacattgttttcatcgcactcaatcaacgctctggcaaaaatactgagctcattaattttcagcccggaattatccaaaaactggcggcaagcgtagtcagaaacaaaaattatgccgggatgaatatcatgttcccgaataaaacgggcctgagcaaatggcgtatccatactcaacacatatactgcccggtttgagtggctacccgctgatttaaggcggtcactatattcttttacctgccattcacaaaccggcgtatccagtgacgggacgacaataatccgcttttttatccccgggatacagtaacccggtaataaattatggctcaccagcccctttgtgcagggtaatggttcgccttcagccagtataccgggtttgagggtcagttgcgttttgccaaaggtcacagcgtgttcctgacccaatgagatataatcttgtgttgttgttggcgtcataaaaacttctccttttaacatttgtattattttagccataataattatttagcaatccgctaaaaaaccaggtgaacatccataataagatgatggtgataaaaagaattatattagccataatgattaatatagttttatagtcttcctctgatggaaatttctttcctgaacaaatcccctgcatattcaaaagatatgtcaatacgttcgttactatgtccacgataggttataacttgtgtatatttacctggcacattttctttcttaatagggccataatcccataagccttttgaattttcatactttacagtcttatcaatgagaacttcatttacaggatttccgtcgatatccttaacaatagttgtgatggtggcactttcacccggcgataatacaggtttatctatactcataactgttaaatctgggcttggcgtattagatatagtttctgtttcaatatactgaaattcagataccgatggcacaggcgtgtaccctgacgctgaagccatatccgtttcattataaatttctagtttaatctttgaaccccgatgttccttttggatattaaatttatgctcacatggcttttcacgtttaagtatatgctgagaattatctttattgatctgataatacgtacatactgtagtaaacgtttccgcagactgatagttattatccggatcgctgatgcctagatatctatcatccctcgcaatagtcattcccggaaaaggtgtatacttttcaatagaaaagtcaagtccattaaacttcaattcgtaggtatcacgaggtgttcctggtctgtgcccaacgctcggcgccgtaggaggagaaaacatcccgacggttgccgcggaagttgtcgacgaatccgccaagacgcttatcggcacagccgccagaagcaggctatagataataagattatgtttcgacatacgcactgttgatcctttttaaaacattaattcgcatcagaggttgcggtattacccttagcatttcccttatcagaaataattctgacgcggatatatttattctgaagcgattccccattaagactataaggaagaagccaggtggcctttgtcgcccccggtacggattgccaggatttcatttcatccgagatttcccactgataattaaacgcatcagtacagtccgtgttatttacacaaagcgttctggctcgcatttctgttccgacgactggcgcagtaacgcttccgttggcttcttcagtaccctgcgtaaaaagcacctccacagaagtgaccttctgcgcaatactgtctgactgcgcttgtagtagtacggtacccttcaccggatgtttatcgtctggtccgcttgcttcaatatgtaatttgagcgagcgggcatcatcgccgatatgggtcaccagaacccgttcaacccaatggccgtcacgctctgtaccaccgagcgctttaaatgccagacccggcgtatctgattgatacttaatatgacgtggtttgagcgacgcccactcctcttcagaacgctcgcgcacgtagtgccactcaataaccttcccctcttctccggcaggaagcggcgtactgataacaaagttgccgtcctcaacctgaacatcgtcattgataacatttatccaggaacggaaactggtctcatcctgtgtcacccttaccgggatacgctcggaggtcacgcgagtaccccggctgtcagtcaccgttaaataaaggctatactcctgaccgtcggtcgccgtcagcggaagttgaggaaggataaggccgctgcccaaactcccctgaagctgaagtccggcgagaagttccgcatcacccgaccactcaactttctcaatcgggtaacggctatctaccgtcgccattaatatcaccagcgtcccggacaggcctgacaccggcattgccataatgcggattttactggcctgctcccgatacgccatgacgatatcgtaattacgatcgacaaaggcacgccgattagtcgtattcgacggcgccccaacgttgcggtaatcaagctgttcatgtaacggcgtaccgaaggaatagttgactctcagaccgccctctgcctgcgatccgccgttaccggcgtcccgatatcctgctctgacctcaagcaaggggacaggattccagaccagagccgcacctgcggcgcggggattccggcttaatgtaccgttacccaatagatcaactttatccccgtaatactgttcatatgtcagctcgccactgaaccagggaaaatcgggaagcgtgccttttgttcgcagatcaaagccatatgccggacgctcatcatgtaattcatgaactactgacgttttccagccggtgagagggaaataatagttgccggaaaaggccagactgtctttatagacttccccgccaatgccgccacgcaagtgggaataacggatgtcggcatccagaaacgtattgacgccgagcagccatccattgacctcctggcgataacccacaccaacgttaacataggtgcggccatcgaaactgctgctgtcgtggtcgcgaaagccaagctggccaaagagtaaagacgatgttgtttcctggacgggaataaacatatcgaactctgatgagcgatatttcgcgccatcttcaagattgacgccaccacggaaaataatctccggaaaagcgctcttcatcccctcgttcaccagatgattagcggcttgccctggtaatgcctttatttttcctttggcataatcctccagcgtcccctcctgcagatgcggagaaatagacgatgccgtccctgcaatccatgactgaatttcattatcgctatcagcgatgaccggcagtggaatctgactggtaacaatggcccaggttatatatttagtaatgggttttttagaaaaaaccactttattgtctcctgctatatccccctgcctggcagagggagtatttaaataagatgtttatttggcgataaccatcagcgacggatagcgcgtttattctccggcgtggctttcgtcgttttaggcgtaacgtggacacggaacagtttattctgctcagttcccttaataatatatttatgcttttcagcgttggtattattcagatcggtgaacctatctggtgtcccggcatccgccatctgccaggtaaagttataattactgacctcacactcagccgccgctgtggcggcacattccagtaccacttcaagggtgccgcctaccactggagtgttggcgtcattggtaccgttgagttcatcagtcggtttaccactttcattcaccacattgatagtgacagaacgtagcttattagaaattgtaccgtctgcggcggagtcgccgctcaccccagaagatgcagaagttaataagacagtggcaggcaagaatgcactatccggcgtccccgttgccgtcttaatccggtaaacgattttaatttttttaccgcctgcataagcaggaatggtaaaagccgtcccggttgccgccggggttccagaaggatcggcggcctcattatccaccagataccatttaatatcgtcggcattattcattttatccagcgataagggatccccatcctcatcctcaataaaaacatccgctatctggagggttgaaccggtcgtcagttccccagacacttctatcttttttgcattagtagttgccacaggacggtgaccaacagaagcaggcgtagcagaagaagccatatcattggctctgatattcgccaccgcctctactgagaccacggatgcacaaatcgctaaagctaataaagattttttgaagtacaaaacaattcatcccttttattaaatcattagaaataattatgagatttataatctcacgggctaaaaattcaggattattcaatcattttaaccgtctgtgaaattatgcccttcgccatgccaattacttagctttactggcaaaagccgatctccaagtgtaaagtttattcagaaacgtcaagcaatttaaatctttcttgttttgccagaaaagctaacaaccccccactggtttaataacaccgtatgtcaaacaccttaaatgtttatattttcggcttcaataaagaggaatgatgatgaaaagagccataatagtctcagtattagagcaaatagaaaaaaatcttgaagagaggattgatattgaaaagttggttgttataacaggttattcgcgaaggagtttgcaggatttttttaaagaaaagtgtggcgtctctatcggaaaatatatcagacaacgcaagttgagcagaagcgccactctgctaaagctgacctctcagtcggtcacagatatcgcgttcagaatggggtttgattcagtgcagtcctatagtcgagagttcaaaaaaacatttggcgtcaatcccaataactatcgcaaggctgatttctgggatctcagaaacctacggcctccctactggcttgactgtgatgggcattatcagttcgaaatttgtcagcttacgtcaaaagaaattttcggatttcaaacatctcatcagatcgcaacaaatgaccttcctaaaaaagcgtcgcctataaaatggaaaatcattcatgagacgctcaggacgtggggcgaaaatgtgtattgtctctcgtcttttaagccggataataccaaagaccaggtcatcgccgtaagcagtttttttggtatggaacataattccgtcgatggaggaaaaatacccatgtcgagggtaataaaatgtggtaaatatgcaaaattccatttcgttggtcataaggaacaatatcaacaattttccaatacaatatatatgtgtatattgccaaaactgaatattatcagaagagaaggagaagatattgaatacttccatttggcatccgtccaaaagcaacagaataatgaatccattgtcgatctttattattacatccctgtactgtaatgacttcgtactatccacgcatttcatctgaaaagtcttctcttttcagaacggtaataaaactctcagtattgattctggtaaaataagtgactattaatataattaacgttttgaaagaattaaaaaaaataaattgcgtgcacgcgacaccggggacagatttctgacagtactgtacggtgtagtgatcaggtaatattggctacagtttacggtaaaagcaaagtccatactttaactattaatgggagtatgctggccgggcggcttgcggggccttcatgctcccacatttacaatgttggtatgattacattctctctatactttactgtgctaaccttttatctcgttgagataccgtttaatttaaatgttctctttttgatgtacattataagaggagacattattcatattttcgaaatcagggcagacgatatgtatacaaccatcagaaacacaacgctagcaatggtagcttgtttttcgtatatcgcacatgccagtacccaccctcctcttattatcaccaggggagccggaggagacgcctccggagccgcagtcattcatgataattggcggcatggcactcctgacctggtcaatcttaccgatatccccatagataaaatcagaccagaaaaataccgttgtgtactgattattgggcaaggagctataaaagagatgcttcttgcgaacaatgcctcagcaatactttccggaaaaactgttggtctttatactcatctgatcgatcagaacacgctcagattacttcggcaattgcagaacaaagtgagattcaatctcttttttacccgctcgcagataactctactaaaactaaggaacatttcagaatataattttttgagttctaaagtaaataatgtctggggacaagactcactagcaattgaaacagtggcacctgacaggggtaatataccggaaaaagcgcttcccctcaaaacaacggattatgtgatctggctgggtggaaactatactacctcttctggtacgcagcgtatcttcacaaacgatcagattgttgtagccctgaaaccactacataatgttatttcaccaaatgcatcgattgctattatgctttcaccacgtttttttgataatagcatgagtaaagaagcaaaagttaaacgactgaaggcagtgcttaacaccttttcgcaaaatagggtcacattttatatgagtaaggagatgcttgctaatctgaaagaatttgatttgcctgttcaactatccccttcttacgcagagctgatgcgaatgccctgggccagcgctacccggcattttgcctctgtggatcaatataacctgtttgctgatctcatacctaaagtcacgccgtttcttcttgaaccgaatgatgccgatcaagctctctatgcgacggattatcttaatacccggcgtgtaagtctgacccaaaatattcttaaccatggttgtgactaaataaaacgcgcagaatccgggatagttagcaatccaaaacagaccgttagccatgagtactgtttatcttcactatacagggaacaaccaaataactgacaacacaaatcaagccgagacccggaattcggctatacaggcgctctattcaattcaggcccagaaacagtccggtacccatactggacacggcctcccaactgctttagcgcattaccagtccagcttcgatgcgccttctgtcgtctgcactatttcactggttttaataacgcgatgataaccataaacatcagcgtatttcgtcattccggttgcggtgtcaacctccggcttaccctgcgtttcaataatctctcccgtccgggtcgtcatggtataggtcgttgtacatccggctagcatcaacactgataagctaagtaccgtaataagactacacttttgcatttcttgtttccctgacacctctatttttgatgtactttaccgaataccgcaacggcaagatggatgattagggctattgctccctgtttgtccgtatctgactggctcaggttttttgatgcgctgcgttaatccggcagtaatcgctccagcacatccccagccagaagcacgctctcctgaagacgctccaggctataccccgctcgcgccttggcggaaagtcccgccattagcgtccccataaagtccgtcgtccggtcagcctcttgcggataccgcatggcgacataagtgcgaatcaggttttcagcagcgatgtaaaactcgcaggcggcctctcgtgccggtttatcgttacaatgagcgccctccagaaccagacatccggtggcatcaggatcggcagcgtaacgtcttgccgcttccatcagcacatcgataagacacttcgcggtcgggcgatcgtgacgcagaagcgccccgagcggaatcgcgtcggtcatcctgtaacgctttaatacgcgagtatacagccccagcttgctgccaaacgccgcatagaaactgggaggattgatcccgaacgcttttgtcagatccgctacgctcaccgcgtcgtatccgcgcgaatgaaataagtgttgagcggtttcaatggattgctccggatcgaactggcgagggcgacccggcgttcggctatgttttgtagtcattactacataactccttgacggcatgatttcattacgcatattgtagtgactactacaatatcataaaggacatcctgatgatgctatttcgcaacaaatctgtactggttttagggggaagtcgtggtatcggcgcggctattgtacgacgctttagcgctgacggcgcatcggtcgttttcagctacgccggatcgcgtgaagccgccgaaaaactggcagcggaaaccggaagcaccgccatccagacggatagcgccgatcgggatgccgtcatcagcctcgtgcgtgagtacggaccactggatattctggtcgtcaatgcgggcgtggctctcttcggcgatgcgctggaacaagatagcgatgcgatagatcgtttgttccgtattaatatccatgcgccttaccatgcgtcagtcgaagcagcccgcaacatgccggaaggtggacgcattattattatcggttccgtgaatggcgatcggatgcccataccgggaatggccgcgtacgctgccagtaaatcagccctgcaagggctggcgcgcggcctggcccgtgattttggcccccgcgggattacgataaatgtggtgcagccaggccccattgataccgacatcaatccggaagatggccccatgaaagagctgatgcacagtttcatggcaatcaaacgacacggaagacctgaagaagtggctggaatggtggcatggcttgccggtccggaagcttctttcgtcaccggcgcgatgcacaccatcgatggtgccttcggcgcctgacggccaggcgaatatcacacggttgccgtctacgctccggcaaccgtgttagaagctgttcatgcgagaaaacatccgcaagcgccgggatcaatcgtggattttaacgccaagacaaccgcgaacaaattcaggattaaaatgcttcaccgcttcgccaacgtagcctaaatcaagggcgttgatttgagccatttcgttatccgttagtgagaaatcccagatggcaaagttctcttcaatacgttcctgtcgagtggatttaggaataaccgtgacgccacgctgcacgttccaacgcaggacaacctgcgcgatggttttttgatgggcatcggcaatcctttgaagcatgacattttcatacggtttatgtctcccgccgcctaacggtgcccacgcttcaggctgaacgttataatgcttcatggtttccagcgcggcgggttgtgcaaagtatggatgcaattcgacctggtttaccattggcgtaattctgacggtttcacagaagttggctaacacatgcgcatagaagttggacacgccaatggcttttagtttaccggcttcataagcgtcttccagcgcgcgccacgcgctaaaataatcgcccattgcctgatgcaataaatagagatcaaaataatctaacccggattttttcagcgacgcttcaatacctgctttggccagatcgtagttagccatatcttgcacccacagtttagaagtaataaataactcctcacgggtacacagacctgtcgcgatggcttcacgaacagcgtcaccaacggcatcttcattgccgtataccgcagcggtatcgataagacgataaccgctgcgaatagcgcttaacactgactgctgacattcttctttgtcggttaccttaaaaacgccaaaacccaccataggcattttaaggttgttacttaatattgaatattccacgctaaagcaccctttcgtcgtaaagacgccatgataagagcaaaatacaggtacaatgagtattgttaaatccgattatatttatacaaaaagttcattaataacagttgtacagattttttattgcatccaaacgttcagtgcttgctatatcctcgccgtgtagcacctgtttgataatgccttttacttatgcgtcaaaaaccagtaccgtcattttgaccgtctgtgaaaaagttttctgaacaggcaatgcgatatccggaataatattttttagcgaagaggctccggctggctcagcgccgttttgcaccagtcataaaaagcgcgtaccgcaggcgacagaaacctgttttgcggatagaccagcgcaagcggcaaatcataaaaatggttgtccatgcaggtcaccagcgccccgctgtgcagatacggcgcaaccagatagctggcgacgcgaattaaccccagcccctgtattccggcctgaatataagcgtccgtatcatcgacaaccagcgtctcctgcacccgcatcgcgtaatcctccccctcacgcgtaaaaaaccagtcggtggtacgcccggtgcggtggttcaggtagccgactgcatggtgtttttgcagatcatctaaattttcagggctaccgtaacgctcaatgtaagtgggcgatgctgctatcacccagttaaagctggcaagtggacgggcaaccagcgtggtggaatcatcgattctgccggcccgaatcacgcagtcatacccttgaaggataatatcctccacgctatcgctggaacaaagtatcagctccagctccggatactggcacaaaaaggccgggagcgtaggaataatgcaatgccgggcgagagattgcggcatccccactttaaaacgccctttgggttgtgccgcccggccaggaaatgacgactccatggccgcgatatctgccagcactcttttgcactcttcgtagtaacgccgcccctctgcggtcacgctaagtttgcgggttgtacgttgcaaaagttgaatcttaagccaggattccagttctttaaccactcgcgataccgttgagcgcggcacgccaagcacttcggcggctctgataaaactatgggtatccactacgcaaacatagacctgcatcgcttccagcttgtccattttccccccgccaattatcccatttatcagaacagtctaacccgtcttcggcgtcttatcgaacgcagatccctgacgtaatctctatctacaggtgaatcaacacagagaggcgcaaatgaaacaatccaataatcaggtgggtgaaaaagtattggtgctgggcgcgggacaactgggggcgtcagtgctggcgtcgttggttccggcgatcacacagcgtaatggttccgtttgcgttattgtgtcagggcgatccagggataaacagagcaaacgacgttccagcattcatcaacaactggcggatgccggtgcgcggtttatcccggtcgacatcgcagacagttcggttgcagcgttaaaagatcaattccacggttttgatacgatcatcaattgtatggggtttgtcgccggtgcgggtacccagataaaaatcacccgcgcggtactggaggcgggcgttaagcgctatttcccctggcagtttggcgtgaattacgatgtggtcggcaaaggcagcggccagccggtgtgggacgaacagtatgacgtcaggacgcttttgcgcgagcaaaacgtcacagagtgggtgattgtttcaaccggtttatttacctcttttctcttcgaaccggcctttgatgtggtcaacttagaccaaaaaaccatcaatgccctcggcggatgggaaaggcaggtcaccgtcacgtcgcctgcggatattggtcgcctgaccactgaaatttatctgcatcagccgcgtatcactaacgaagtcgtctttgttgcgggggaaacgacctcttatgcaaaactggcgaaaacggtcgaacgcgtgacgcagcaaacctttacccgaggtgtattgacgctacctgacttacaggagcaactccgtttacatccgcatgacccaatgctgcgctatcgcgtcgccttcgcgcgtggtgacggtatgtggtggccgatgagtgacacctggaatgcacaacatcatctgccgacacaggatattgccacctggctgaaaacacagcaatgagaacggcggcatcaggcgctcgcttaatccccatgccttctgccagcatcaggcggcgggcgtggctaccttgagttaacaagaaaccagtacgcatcagtgcttcacgatatacattgtacggctataggccacatcttccgggttagtaatggggtatccctttacccacggtttaattaaccggccattggtatactgataaataggtgctataggcgcttgttccgttaaaattttctccgctgcattgtaatccgcgttacgcgcttcggcggtattttccatcgtcgcttgcgtcaggattttgtcataagtcggattagtaaagcgtgaaatattccccgtatgcgtggacgttaataaggataagaaagtcgacggttcgttgtaatcacccacccaggagacgcgaataacatcaaaattactggtattccggctgtcgatatacgttttccactcctggttttgcaatttcacatccacccccagatttttcttccacattgacgccaccgcaatcgcgattttctgatggttttctgaggtattgtaaagcagagttaatttaagcggcttctgcgatccgtagcctgctgcacgcagcaatgttttcgcctgggcgttaagttcttcctgactcatttgttcaaacggtgaaggatcgggcttaaatcctgccgtgacatccggtgtaaaatgccaggccggtttttcaccggtacctaagactttttccgccatcaaacggcgatcaatggtcatacttagcgccagacgaacgcgggaatccgccgtcggccctttctgcgtattaaacgcataataataagtccctaattgcggcggcgtataaacttgccctggaatatccttcaataatttctggtacatatttttagggaaagattcggtgatatcaatatcaccggcaagatagcgtttcgtcgcagccgactcctggttaatgggtaaaaatgtcactttttgcagtaccgttttcgcgttatcccagtaatgcgtattaggcacgaccaccagtttttcatttaccacgcgctctttaagcacatacgcgccattgccaatcagttttcccggcttcatccagtctttgccgctttcgacattcgctttttggaccggataaaaggcaaaactggcggtcagactggcaaaccagggcaacggcttgtcaagctgaacacgcaaagtgtgcgcgtccacggcactgacgccaagctgatccggcgtgactttactgtcgataatggcttgcgcattagtgatgccagccagagcggcaaaccaggcgaagggggaaagcgttttgggatcaacgaggcgttgccagctatagacaaaatcctgggcggtcaccggcgttccatcggcccattgcgcatcatcccgcaacgtaaacgtccagatacgattatcattgctcttccactggctggcgacgccagggataatttcacccttttcgttctggttaaccagcccttcaaacagatcgcggatcacctgaatttcaggcagcccaacggctttcgctggatctaacgaagcgggctcatctttgatatgacgcaccagttcttgtttctctgccagtaccgttccgccgggaacatccgcagcatatgccagggaaaagctgctaaccaacagcgcacaacaggttactgaaacagaatgcctcatagaagttcctcaaagatgagttaaatgacaacgtaattatttgtttcagcagaaagaaatgcaattatcttccgccagaaagttgatatcgcgccatacaagagggtaaatagaaaccatttgataatcggcgggttttacacaacactacgatgattaccctactggtctcagcttcgggaaacgcgtatgactgtcacccgcccccgtgccgagcgcggcgcatttccgccaggcactgaacattatggacgttcgctactaggcgcgccgctaatctggtttccggcgcctgccgtcaatcgcgaaagcggcctgatactggctggcacccacggggatgaaacctcatccgtggtgacgctctcctgtgcgttacgcaccttaaatccgtcccttcgccgtcatcatgtcgtacttgccgttaatcctgatggctgtcaactggggttaagggcaaatgcgaatggcattgatctaaaccgtaactttcccgccgccaactggaaagcgggtgagacagtttatcgctggaatagccgcgcgcaagagcgtgatgtcgtgctgctaaccggcgaccatcccggctcagaaccggaaacccaggcgctttgccagttaattcatcgactccaacccgcctgggtcgtctcttttcacgatccgctagcctgcattgaagatccacgtcgcagcgagctaggcgagtggctggccgatgcgtttgcgttgccgctggtgaccagcgtaggttacgaaacgcccggttcgtttggcagctggtgcgccgacctcaacctgcactgcattaccgccgagtttccccctgtttccgccgatgaagccagcgaaaaatacttgctggcgatgtcgaatctgctccgctggcatcctaaagatggagttgacccgtcgtaaagcgtagcgcaggctcaacatcaaccgccagccatgttgggccatcaagatcggcgaagctcacctgcggcataagcggcagcgcggcgctaatcgctcttgatgtacagagcatacagcccagcatcaggccgaatccttgctcccgcgcctccgttgccagcgccagcgcctcagtcagaccgccggttttatccagcttaatgttgatcatatcgtagcgccccgtcagggctttcagactactgcgagtatggcagctctcatctgcacagatgggcaacggatgaataaaattttccagggcggcgtcatcctgcgcgggcagcggttgctccagcatcgcgacattcagatccgccagtaactggcaacgcgccgccagcccttctgggcgccacgattcattggcgtccacaatgagcgtcgcctccggcaccgccgagcggatcgccaccatacgttcgctaatcagacgagcatcgagtttaattttcagcaacgtcgccccttttttccatagtgccgccgcactggcagccatctgttccggcgtgcctatcactaccgtttgcgcggtagtaaaaaccggggacggcgtcacgccgagcagcccggcaaggctttgctgccgctggcgggcctgcaaatcccataaggcgctatccaccgcgttgcgcgccgcgcctgccggcaacagtttctgcaatgcttcgcgagtcagcccgttttccaactgaggcacaatactcatgatttgcgccatgaccgaggcatcactttcaccataacgtggatatggcgtacattccccgatgccttttacgccctcttcttccagttcgacaacgacaacatgcgcttcgcttcggctaccacgcgcaataacaaaaggcgtatgtaacggccaggtttcctcatataccttaacagatctcatctcttcccctctgatagcgccggacgcggcttgctacaaatagtatttgccgtgttaatgaataatgacttaaactggatttcgacgttaactataagtaaataggaacataattatgtcacagactgtacatttccaggataacccggtcaccgttgccaacgttattccgcaggctggtagcaaagcacaggcttttactcttgtcgcaaaagatttgtctgacgtttccctcagccaatatgcaggcaaacgcaaagtgctgaatattttcccaagcattgatactggcgtatgcgccgcatcagttcgtaagtttaatcaactggccacagaagtggagaataccgtcgtattgtgcgtttctgctgacctgccttttgcacagtcgcgtttttgcggcgcggaaggcctgagcaacgttattacgctttccactctgcgtaataacgagtttctaaaaaactacggcgtcgaaatcgttgacggcccgctgaaaggtttggcggcgcgcgcagtcatcgtgcttgacgaaaacgacaacgttattttcagccagttggtggatgaaatcacccacgagccggattacgacgccgcgcttaatgtcctgaaggcataagccagcgcctgctggcgctacgtttgtcagtgctacaggcggtgctcttttgtcacaagaaggcctctatccggaggccttcttttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcctgtttacgggccgtaagtaacgaagtttgatgcaaatgtcagatcgtatgcgcctgttagggcgcggctggtaagagagccttacaggcgcatcagaaaaacctccggctatgccggaggatatttatttttctactcttcacccttcttctggctcagaccatattcacgcagcttattggcaatcgcggtatgcgatacccccaaccgtttcgccagtttacgcgtactcggatagctacgataaagctgagtaaggacagaacgttcgaaacgactggtaatgtcatccagcgaaccttccatcgcatcctcgccgactgccaccgtcgcggcatcgtagtcaggcaacaggatgtcctgcggacgcagctcatacccttccagttgcgtcagcgcccgataaatcgcatttttaagctggcgaacgttacccggccagccgtaacgagtgaggaccgtactcagatcggcagacagtttcggtcgtggaacgccctgttcgtcggcaaaacgcgccacgaacagttcggtcaacggcataatatcctgcggacaatcgcgcaacggcggcaaattaagcgtcagaacgttaagtcgataatagagatcttcgcggaacagtcctttttgcaccagctccaccagatttttctgcgtggcgcagataacgcggacatcaacatgaatttcgtgatcttcgccgacacgacggaacgtaccatcattgagaaaacgcagcagcttcgcctgcatacgcggtgacatttcgccaatttcatccagcagcaccgagccgccattcgcctgttcaaaaaagccttttttaccttccggcgcatggccaaatagttcgctttctaccgcatcttccgggattgaagcgcagttgagcgccagatacggtttcgctgaacgagggcttgcctgatgacaggcataggcgaaaagatctttgccggttcccgtatcgccggtaatcagcagcggcgcgctgagcatcgccagtttgcgcgcctgctcaacgacgtgcttcatctttgcgctcacggcaataatctgactaaacgcgctcagatcctgcgtggacaaattctgtagctgctgtcccatacgaatcgtggaacgcaacatcacgaccgccccggtcaacacgtattcgtcattttcgttttgtaaatgtaccggcgtaatctccatcaggaagttttgcccgttgatcacgacatgttcgttatgggagctttgcgggttaccgtccagccagcgctgaaaattgaagccgttgattaattgtgcggcggtatggtgccgcattcgctcctggctctgggcaaaaagttgacaactcgccgggttcgccatctccactttactcttcatatccaatgagagcaccggctccggcaacgcctcaagcagcgcgctcagggccagatgttcacgttcggacggcatccagggaacggtacggacatccgttacgccggaaatacggcggatttcggccatcaggctgctgaagtcggtgaattccagctcagcaaaattaagataaattcgcccaatgggatcaatctcgattccgcgtaaatcaatgctacgtaacaccagtaaatcaagtaattcgcgggtcagaccaagtcggtcttcacaaaagacttccagacgcatgggaaccttcacctgaataatgaaccattaaatagatgataagccactattcggctggcaggaaggattctgtcaacaaatattgacagcatggcggaaaaacgggcgctgcggcgtaaagccaggcaatcagcgccctgtggaaggtcatttctcaggcgacgacttactcttttgcagcgtctcttttagctgaccgataagctgacgacgaaaatcaccgagacgtggtttatcgttatcggcccacggcaatggtcgacatagctccatcgcttttattcccagtcgagcggtaaggaggcctgcgccaatcccctgcgccgcgcgcgtagacaggcgtgcggccagatcctgagacatccagtccataccgacttcacgcaccagctcactggcccccgcaaacgcgatattcagcaacaccagacggaacagacgaaggcggctgtaataaccaagttcaatgccatacagcgttgcgatgcggttaatcaggcgtaaattacgccaggcaataaacgccatatccaccaacgctaacggactgacagcgatcatcagagtcgattccgcggcgaaacggctaatctcacgtcgcgcctgcgcgtcaagtaccggctgtaccagatgcgcatacaagccgacgatttccctgtcgttttgcgtttcgtgaatagcggcataccaacgttgtaatgccggatgtgattgatcaatccccgcctgctgcgccagtttttcgcaaaatgcgcgacctttcacgacgctatggctatgtaacagttcacgcgcctcatcgcgctcatgcgcccgctggcgcaagcgccataatcgccaccactccgtgaccaccgatcccacgccagcgccaacgatcagcgcgcctgcggcacagccgcctaaagcgacccagtcctgagtttgccaggcattcattgtccactgtacgccttgcccgaccacgctcgcgccaaacagcgccagccctcccatcaccattttacgccacaggctgcgtttggggcgcagcgcggcatcgaccgccgcttctgccacgccttcgtcttccgggcgctcatcgatagccgcaggcgcaaatgtatgcgactccgcttcgctgaaagtttgctgcgctttgaaggccgatgtaggttcctcctttagcggttctgcaaaatcaatacgcggttttaacggttcgctcatcgcagcttatctcctattaaaaactccagcgcagcgtccagacgaatgtgtggtaatggtttatcaacatccattacctgcggacgaaaggcttcgaactgaaagccctgcttatcccaaaacgcttgtcccggcaaacgcgaaggcacttcgccggggtacacggttaacggcgcgccgtcactcaaacggtttccacgtaaagccgggattttttcaccgttgacctcaatcacgccgctggtggtcgcctgtaccgacgccagccccaggcaatccatactaatgccttcaaacgcggcattttgccaggcatcctgaataagctgctggagcaaggccaccatattggcatgttggtcgagggtgacatggtcggctttcgtcgcggcgaacagcaatttatcaatcaccggcgaaaacaagcggcgaaacagagttcgctgaccatagtgaaaactttgcatcagctgcgttaaagcgagacgcatatcattaaacgcctgcggcccgctattaagcggttgcagacagtcgaccagcacaatctggcgatcaaagcgtagaaaatgatttttgtagaaccctttgaccaccttttcgcaatagtagttaaagcgttcgcgcagcattccagcgttggtctgtttatccgcctgcgccagttttgactcgccgaaggcgtccacatccggccacgggaaaaactgcaacgctggcgcgcccgccatatcgcccggcaaaacaaaccgtccaggctgaataaaatgcaatccctgcgatttacactgatgcaaataatccgtccaggcggcggcaatctccgccagccgattttcatcggcgggcgccagcggatcgagcccgtcgcaaagttgccgccattttgcggcccactcagcgcgttgcccttgtaacaagccgttcatctgacgggaccagcttaaataatcctgagccagcatgggcagatcgagtaaccattcccctggatagtccacaatctccagatacaatgtcgaggtatctttaaaatggcgcagcagcgagtcgtttgagcgatagcgcaacgccagccgaatctcactgacgccgcgcgtcggtgtgggccaggcgggaggattgccataaagctgaagtatcccctcgtcgtaggtaaaacggggaataccaaaatcacgttgaggcacgcgctttacgccaagcaggcgttcttcgcgtaccgcgctgagcaacggtaagcgcgcgcccgcgtggacattaagcaactggttaaccatcgccgtgataaacgctgttttaccgctgcggctcaacccggttacggcaagacgcaaatgcctgtctaccccacgattgaccagcgcgttgagttcagttttaagtcgcttcattgacatcctgttgagcctgaagagaagaaaaaataataacgagcctgcgttatagatatgtgcaaaaacgttattatcaactacccggagagatcaacaacggcgcattaagcgccgcggttagtatgagtattgagcaatagattatctatttttttactttcggcatatcaagacgactgatgccgcccatattcatcgcgtgcgtataccccatatcaagcaacatttgttttgccatgcccgactgtcgcccggagttgcaatataactttaccgtatcgttcctgtctggaactaccgtttcgatatgagatttaatctccttcaatgggatattaatcgcgccctgaatatgctctcgttgatattgttccggaatgcggacatctatccagtattctgcggcataaagcggcatggctacgaataacgctaacgcaaatattccttttttcaacatactcccgtcctgacacgtaatgtatttcgcacacactatacgccagagcttaacgaaatattatgaccagactcgctatttgtaacgctgcgaaattttattcgccgccttacgaagtactggctccagcgcaaacgccagcaacatttttagcggacgacgggcgacggattttaccgcccatcccgccacgccggcaggcccgtagcgtaacgcggtcaacagaaccagcttacctgctattttgaagccgggcttcaccttctgcccggcgcgttgccagcgagtattcatcttcaccttcccgatatatcagttacagttgacggaaacgactacgcagtgtgaacgtatctgacgtgacgtagcgttccatttctcgcaaacgcttttcgcctgcggcaagctctctgtctacggtatccagcagttcgccgctggtcggctgcggtttccctgcggccagattatccggcatagggtccagtacaaaagacaggacgatataggccactacggtaaaaaacgccagcccaaagaaaatcgacagcacgaccagaatacgcaccagttttaccggtacatcaaggtagtcggcgatcccggcgcaaacgccacgcaccatgcccttttgcggcatacgccatagttttttattcagattgattccactcattagcgctctctccagttcggatgctctgcatcaagaatatcttccagcgcctgaatgcgctcgcgcatacgttgcgcgtcgtctgtgagttgcagtaagcgttgctgctcgctttgcgacagttctccccgaccggcgcggttgctgtaatgcagccacagccaaatcggtaacacaaacaacacaaaaatggttaacgggatggccagaaatagcgcgctcatgcgttctccttacacctaaagctgatgagcgacggcgcgtaccggcgccgccattgtcattattgattatcttgcttcattttggctttcaactgcgccagctgctcgctgatttcatcatcggctttcaggttggcaaactgttggtccagcgattgctgcttaccaaaacgatggctttccgcttccgcttccatttgatcgatacgacgttcaaaggattcaaaccgcgccatggcttcatccagtttgccgctgtcaagctgacgacggacatcgcgggaagaacttgccgcctgatgacgcagcatcagcgcctgctggcgagcgcgtgtttcgctgagtttgttttccagctcgccaatctctttcttcatgcgcgccagcgtgtcatccaccagcgtgacttcctgttcaagcgtagcaattaaatcggtcagcttttgtttttcaatcaatgcggcgcgcgccagatcgtctttatctttgcgcagagccagttccgctttttcctgccactcggtctgctgagccgtagcctgttcaatacgacgggataactgtttcttttccgctaaagctcgcgcggagttcgagcgaacctccactagcgtatcttccatctcctgaatcatcaggcgcaccagcttctgcggatcttccgctttttccaacaacgcattgatattggcgttcacgatgtcggcaaaacgagaaaaaatacccataattcaatcctcacataatgttctgataacgggcgatgccctgctacatgattaatacaatttgcgtgccaactttttatattattgatagttaaggaattatttcgttttacctcgccagccaaaaaggataaagtggtgaaaaacactaacaagtggcgattttcatcatggctgaatttaaagataacctgctcggcgaggcaaactgttttcttgaagtactggaacaagtctcccggctcgcgccgctggataagccagtgctgattattggcgaacgcggtacgggtaaagaacttatcgccaatcgcctgcactatctctcttcacgctggcaggggccgcttatctcgcttaactgcgcggcgcttaacgaaaatctgctggactccgaactgtttggccatgaagcgggcgcttttaccggggcgcaaaaacgccatcccggtcgttttgaacgcgccgatggcggcacgctgtttttggatgaactggcgacagcgccaatgctggtacaggaaaagctactgcgggtgattgaatatggcgagctagagcgcgtcggcggcagccaaccgttacaggttaatgtgcgattagtatgcgccactaatgccgatttacccgccatggtgaaggaagggacatttcgtgccgatctgctcgacaggctggcttttgacgttgtacaactgccgccgctgcgcgaacgccagagcgatatcatgctgatggccgagcattttgctattcagatgtgtcgtgagctacgtctgcccttatttcctggttttaccgatcgggcaaaagaaacgttgttgcattacgcctggccgggtaatgtccgcgagctgaaaaacgtagtcgaacgttcagtgtatcgccacggcagcagcgaacatcctttggatgaaattgttatcgatccttttcaacgctatcccgccgaaccgcccgcgcccgccctgccagcggcatccgccacgcctgacctgccgctcaacttgcgggagtttcaactgcaacaggaaaaagcgctgctgcaacgtagcttacagcaggcgaaatttaaccagaaacgagccgccgatttgctggcgctcacctaccaccagtttcgcgccttgcttaaaaagcatcagctttagctatttctccggctaattgacgacatttacgccagttatccaccgacatttttacgtggcgggccgaagtgcgatacactttgcaaattgaacttcaaaaacttaactattatgcgcctggttttatcatctctgatcgtgatagcgggtctactgagtagtcaggctacggctgcgactgcgcccgaacaaactgcgagtgcagatattcgcgatagcggctttgtgtattgtgtcagcgggcaggtcaacacctttaatccgcaaaaagcgagtagcggcctcatcgtcgataccctggccgcccagttatatgaccgcctgttggatgtcgatccctatacttatcgtttagtcccagagctggcagaaagctgggaagtgctggataacggggcaacgtaccattttcacctgcgccgcgacgtttcctttcaaaaaaccgcctggtttacgccgacccgaaaactcaatgctgatgatgtcgtctttacctttcagcggattttcgatcgtcgacatccgtggcataacatcaacggcagtagcttcccctactttgatagcctacagttcgccgacaatgtaaaaagcgtgcgtaagctggacaataacaccgttgagtttcgcctgacgcagccagacgcctcctttttatggcatctggccacgcactacgcttccgtcatgtctgctgagtacgccgcgcagcttagccgaaaagatcgtcaggaactgcttgatcggcaaccggtcggcaccgggcctttccagctttcggagtaccgtgccgggcagtttattcgtctccagcgccacgatgggttttggcgcggcaaaccgctaatgccgcaagtggtggtggatttaggctccgggggtattgggcgtttatcgaaattactgaccggtgaatgcgatgttctggcctggcccgccgccagccagctaactattttacgcgacgatccgcgtttgcgtctgacgttgcgcccggggatgaatatcgcctatctggcctttaacaccgacaagccgccgttgaataatcccgcagtgcgccatgcgctggccttatcgatcaacaaccagcgcctgatgcagtcgatttattacggcacggcggaaaccgcagcctccattttaccgagagcctcatgggcttacgataacgatgccaaaattacggagtacaatccgcaaaaatcgcgcgaacaactaaaagcgctgggcattgagaatcttacgctgcatctctgggtgccgaccagttctcaggcctggaacccaagcccgctaaaaacggcggagcttattcaggcggatatggcgcaagttggcgtaaaagtggtcattgtgccggttgaaggtcgttttcaggaggcgcgcctgatggatatgaatcacgatctgaccttatccggctgggccacggacagcaacgatccggatagctttttcagaccgctgttaagctgtgcggccatcaattcgcaaaccaatttcgcccactggtgtaaccctgaatttgacagcgtgctgcgtaaggcactgtcgtcgcagcagttggcttcgcgcatagaagcgtatgacgaagcgcagaatatcctggagaaagagctgccgatactgccgctggcatcatcactacgcttacaggcttaccgctacgatattaaaggactggtgttaagcccgttcggcaatgcgtcttttgccggcgtctcccgcgaaaaacacgaagaggtgaaaaaaccatgattatcttcaccctgcgtcggttattgctgttgctggtgacgctattcttcctgacctttatcggctttagcctgagctattttacgccgcacgcgccgctacaaggcgcatcattatggaatgcctgggttttctggttcaacggtctgctgcactgggactttggcgtgtccagcattaacggccagctgatctccgaacagcttaaagaggtgtttcccgccacgatggagctgtgcattctcgcctttggttttgcgctgatggtcggcatcccggtcgggatgctggctggcgtgacgcgtagcaaatggccggatcgttttatcagcgcgctggcgctattaggtttctcaattccggttttctggctggcgcttctgctcacactgttcttttcgctcacactggggtggctgccggtatccgggcgatttgacctgctttatgaagttaaaccggttaccggtttcgccatcattgacgcctggatttcagattcgccgtggcgtgatgaaatggtaatgagcgccatacgacatatggttttaccggtgctcacgctttccgtcgcgccgaccacagaggtgatccgcctgatgcgaatcagcactattgaggtctacgatcagaactacgttaaagcggcggccacgcgcggcttgtcgcgctttacgattttacgccgtcacgtgttgcataatgcgctgccgccggtcattccccgtcttggtctgcagttttcaaccatgttaacgctggcgatgattaccgaaatggttttcagctggccagggctgggacgatggttaattcacgccattcgtcagcaggactatgccgctatttccgctggcgtgatggtcattgggtcgctggttattgtggtcaatgtgatttccgatattttgggtgctatggctaaccctctgaaacataaggaatggtatgccttacgataagaagcaataaaaatatcattaaatcaaaaagttatgcttttatttttgtgataagttcgttttttagtacgtaaatatatacatattgttttctattttctccggcagtccatgcttcgatgatgattgccggagatttatcttctctatcagcgcctccgggtttcactgcgtgatgctgcaggaagttttctgtacagcgtcgacagcccccataaataatcgctacctgctgtcgcggtacttctgacccaatcagacgccgggcctgcgcctattgttccaatgttagtttcggtcgtcggccaccattacgccccctcgcccttgccgcttccagtccagcgcgggttctttccacaatcaattcacgttccatttcagcgagtgcgcccatgacatgaaagaagaatcgccccattggcgtcgacgtgtctatgctgtcggtcaggctgcggacattaacgccgcgttcgcgcaattcttctaccagaacgaccagatgacgcatactgcgacccaggcgatcacgcttccatacaaccagtatgtccccttatgataacgtcctgactaaaaggaacaggcttcacgggctggatttatccaacaaagcgcgtagtgagtgcttcccgttagcctgaatacgaaaaaggccacgtaaatgcgcagcctttatggtgagagttctaatcttaagaggcactccatcaaacaaaccacccacagttgtcagaagcttgaaggagtgctttggggtgacagtatctgcggcattgttgccacgaacaacgttcccgcaaatgctcaaaatacaatcccaaaatccgctccagtaaacggtctgaatatcgttgccccacagatcgctacagccatacaggaacctgataaaggttcagacataatcgtctcaccaacaagattaagcctgttctttagagcgtttaatacccagcaacatttaatttgtcaccgtaggccccatacaataacttgatgagctacaagtagttatcgcaattaattccctggaagagaatgcacttttgaaatcggggtcgcgccaaacattctctttataatatatccttacatccccccctgttgtataataatactttgctgtatttagcatgttatcaaacccctgtttatgattcccgtacacatccactttacacatggcattgatactaatagcttcactcccgtgcttcagtccgatacaaaaaaactgagtttccttaccccctgacgtatacacaccataagacaggttgttaatctgaacattactcacatacgtatcataatcagccatagctgcataacaaacactggatattgacgcaagagcaagagtcagaacctttaatttctttttcataatccactccaacaatatttaccatacttgtatttctatcgtaaacaagctcaactgcttcatggatattttcaattgggatagaatttacagatacatactcactttgtaaccgcatcatcactcgctcaaaatgaccaaactggataccacataactcaatataagcaacagacggcggaaggctgtagaaactattgtctgcacggattctgtatctgtacaacctgccgctaaatgttgctctggagtaatataatcgtgctatattataagcctcattaatatctgagatagtcgcaatatagtactgtctcgactaccggatacacaggagtcatctcttatatgttgctgaagattcctgttatttccgtgagaagcaaaaccatcccgaaaaatcacatctgaaggtctcgagtcaacacgatatacaaaatcaacggcacctgaatgaccaaaaaaatactaaaaataatattacttttttatcatactctctcctacagaaactatcaggcaaaccacctaatgtgttaaaccgagtgctaaccatagctcagtcatactttacgtctcgctggataaaattagaaaaacaaacctccccggtttacgggcacgaaaatcccggtaattgcgcaatgccgatccttaaactgcggcactataacggcttcccctacagggagccgttttgttatgtcacttctcaatgacctgctcgatttcagcgaccatccccttatgccaccgccttcagcgcagatgtttgcggaacatcttcctgctgagtgtatacaacactgcctgacgctctctaagcatgcaaccgttcgcctggcgttcggctttatccgcctggtgtttacctctgatacacctggctgcggctttactcttttctttggcacgcagttccagcgcgtagatagcaccatgttcaggacagcaccagacaacgttgctgtaagcaggaggaaaccattcccgacaaactttgcatttacggcgcggtaatttagccatgctcacctcagacccggttacggatatagcatctaataacgttagattatgcatgcctgacattgttaggcgagaatacggaagagtaataattcatagcatatctatattaatgcaaataaaatacagtcaacagatttctccaattttattatatataaacagaggcttacgttgagtaataacaagatcatacaatcccgcaccagtaaaattaatgtaaaaacaggcgtaatcatgtattaatattgactggacagcaggtaagtgataacaaataaatattaaaaagtaaatatcacataataaccattatcactacatgagaggtgaatatgatgaaacctatttctgccgcgatcctcaatattagaggggcagcccccggcactgccactatcggaaatggcgcaactaacctagccaaagatattattagggtagctaatattgcttataatatttcacaggttgagcaaaaaagtggtttcttgttagtaacgggagagaaaggcttcaacaaatctgcttgcctgcatatgctgggacaacaaatatccagagttttttctgggaagcacttatatcctggtgtttttataagtaaagacgcagcgtccgaatttgaaaaaacaatcagcactcattataaaactctttcgggtcacattgatctgcaacaatacactaatgatgtaaattgcggagcagctgtaggtattgttgcacggcagcaagaaaacctcatactagatgagatcacattaagtacgtttaaaaaggtctatgttaggtttttacgatattgtaaactgacagttactgtataaataatcggtaactgtcagctcacatctgagctaataaatatcattccccctgctgacccgctgcagcagtttaagacgcaacacctcatgccggagtattccgatctgtcttattgtgaacctcccaaagactaatgccgcaactgaacacaaactccgccagatactttaagccggactattccccggatgccgccgcgcgccgcttctacaaatactgcaacatcctgatcgcgccatacttcaaactagtgccagacgccactgtcggtcttaatgaccctggcccaaattccgtacagtgctaaaacttctcccagtagtcgtatgttcttttacggttaacgcttctgtttttttcttcttctccagcaccatctggcgacgaggatcgagtccctcagttaaccatgatctaaagtactgacggcgttccctggcatgagatagtgatatggttggataatcgccaatcgtcagttgagcagcgttcccgttccatctgtatcggtaaaagaatgttatactgccggatgtagagagcctgacattgagaccatgagcgtctgagatgaccttgatttggtctctttttttgccaggagcctttcttaattttgtatcggcaagcaatgtgtacactccataagaggatatacacatctgtgtatacattttgcataaattgataaccttcacattaatgcaaagtacacaaaattgagacgcttacaatccataaccaattgatagtgcttgaaaatttcaaaagacataaagcatggtaaacaaaaataaaacgagtaaatatgccttacgatagcgtctacagcgaaaagcgcccgccaggcaccctgcgcactgcctggcgtaaattttatagcgacgcgcctgcgatggtgggtctgtatggatgcgccggtctggcgttgctgtgtatttttggcggctggatcgcgccctatggtatcgatcagcaatttctgggctatcagctactgccaccctcctggtcacgctatggcgaagtctccttttttctggggactgacgatctggggcgcgatgtgctgagccgcctgttaagcggcgcggcgcccacggtcggcggcgcgtttatcgtaacgctggcggctacgctatgtggattagtcctcggcgtagtggcaggcgcgacccacggtttacgctctgccgtactgaaccatattctggacacgctgctttccatcccttcgctcttgctggcgattatcgttgtggcatttgccggcccacatctgtcacacgcgatgtttgccgtctggctggccctgttgccgcgaatggtacgttccgtctatagcatggtgcatgatgaactggaaaaagagtacgtcattgctgcccgtctggatggcgcgacaacactgaatattctgtggttcgccattttaccgaatattaccgccggtctggtcaccgaaattacccgggcgctgtcgatggcgattctggacatcgccgcgctgggatttttagatctcggcgcgcagcttccctctcctgaatggggcgccatgttgggggatgcgctggagttaatctatgtcgcgccgtggaccgttatgctacccggcgcggcgataacgctcagtgttttactggtaaacctgctcggagatgggattcgtcgtgcgattattgcgggggtggaataatgccgttactggatatccgcaatctcaccattgaatttaaaaccagcgaaggttgggtaaaagcggtcgatcgcgtcagtatgacattaagcgaaggtgaaattcgcggcctggtaggtgaatcgggttccggaaagagcttgattgctaaagctatttgcggcgtcgcgaaagacaactggcgagtcactgccgaccgtatgcgttttgatgatatcgatctgctgcgcctctcctctcgtgaacggcgtaagctggtcgggcataatgtgtcgatgatcttccaggagccgcagtcgtgccttgatccttccgaacgcgtcggccgccagttaatgcaaaatattcccgcctggacctataaaggccgctggtggcagcgtttaggctggcgtaaacggcgtgcaattgaattactgcaccgggtgggaattaaagatcataaagacgcgatgcgcagttttccctatgaactaaccgatggcgagtgtcagaaagttatgatcgctatcgcgctggcgaatcaaccgcgactcctgatcgctgatgaacccaccaactcaatggaaccgacgacgcaggcgcaaatttttcgcctgttgacgcgactgaatcaaaacagtaataccaccattctgttgattagccacgacctgcaaatgctgagtcagtgggctgacaaaatcaacgtcttatactgcggccagacggtagaaaccgcgccaagtaaagatctggtgacgacaccacatcatccttatacgcaggcgcttatccgtgcgattccggattttggcagcgcgatgccgcataaaagccgtctgaatacgctgccgggcgcgatcccgctactggagcagttaccgataggttgtcgtctggggccgcgccgcccttacgcgcaacgagaatgcattatcacgccacgcttaaccggcgcgaaaaatcatctctatgcctgtcattttccgctgaatatggagagagagtgatatggtggaaactctgcttgaagtgcgcaacctgagtaaaacctttcgctaccgaacaggatggtttcgccgccagaccgtcgacgccgtgaaaccattaagctttacgcttcgtgagcgtcagaccctggccattatcggcgaaaacggttccggcaaatccacgttggcaaagatgctggccggcatgattgaacccaccagcggcgagcttcttattgacgatcatcccctgcattacggcgactattcgtttcgaagccaacgtattcgaatgatttttcaggacccttcaacgtcactgaatccacgtcaacgtatttcacagattcttgacttccccctgcgccttaataccgttctggagccggaacagcggcgcaaacagattgtcgagacgatgcgtatggtggggctattgcccgatcacgtgagctactacccgcatatgctggcgccgggacagaaacaacgtctgggtctggcccgcgcgctgattttacgcccaaaagtcattatcgcggacgaagcgctggcttcgcttgatatgtccatgcgctcgcagctcatcaatctgatgcttgaattgcaggaaaaacgaggcatctcctatatctacgtcacgcagcatatcggcatgatgaaacatattagcgatcaggtattagtgatgcatcagggggtagtggttgaacgcggcagcaccgccgatgtgctcgcctctccgctacatgagcttacccgccgtttaatcgcaggccattttggcgaggcgctgaccgctgacgcatggcgaaaggatcgctaagcgacacaaataccctcagttcgattctctgagggtgttcacgcgacggcccaacagcaatgtttcaacctcttctaacgcaacggaaggaaataacgtgccctgggttgcccaaatgcctgccgtttttaacgccggcaaatagcgtgtgttttcctggccacccaccacgatcttgtcacaataacgccggatatgtttgacaagcagcggaaacgtcattttttcaatttgtgagataaaaaagctgcgatcaagttttacgccgctaaaacacccgcaaactaatggcgcagcggttgcgttccctacgcccaggtcgcccagccataatggattaggttgcttatgaagcgcgtgtattaaaggatcgattaaggcgttatcttgacatgaaaaatgttcagcgacctgcaactccacaaatagcatggcgtgtagtaatgcgcgaatatctttgtcctgaaggacaagctgcgccataccccgatcgatatttacgatacagaacaggccgtggcgtagaaaccagccatgtttggccgcgattgtccgcaacagatcaagcagaaaacggcgcttctgcgaattgtcccatgacgagataacaaactcagggtgtagcggacgagcgggcgacgatgcaaaatgggtagtgatttcgacacccagtaaatccccctccattgcccttatcggctctgccataaaaaaatagcgcatgtgaccactccacttgatcttaactccctgataatgcgcttttaacgcaaatcaatcagtaaaaacgatcaatatctaaaaaatgatcgaaaaaaacaatatatattaacttcatgataacttgctaattttatgttttgagaatgttcttctattgctataagtaaatttacatactacgccgaacaacgctaatacgacggcatgagaccatccgtaaagccaggtttttcttgtcaggaagaggggaaaaatcaaggcgagttaatagtgttgcaccatcgcgtggcatttcacccactatggcagcgcggcatcgccaaccctagtggcgagttgcatctccgctacaggctgtccagatcccccgaacgacctttaagcgaatagcaactctcaataattgattggtaaatctgtagcgaatgtgcccccggcgattcgcagaaaagaacggaactaaatgctatttttttaattcatcctttaataccttagccacaagagtcccttcctccggcgcggctagtttaaaacgtcttcctggcgcaggtgcctgttcttcctctccgattaactcatcaagttctgtaataagtgacttataatattcaatatcttcagtatttccttcggtctcggactgctttaattttaccaggtaacgggccttaatttgctcttccagttgccttgttgcaagagaaacgcttcgctgttgccgggattcttgtgacagcacgatttgatcgccatcgacaaagaaaagtaccccctctttaatcagaatattacctacgttatctatatcatgcatataaaccccccgggattcaagaagcgcctccgccattcgatagttatcttcatcttcaatatcgaactcctgaccttgaatatattttgaaactaaaactgtaacgtctttaccattaatattcatggaggccgaacgagaaaaattcttgtcgtcattggccatattcaaatacttactgacacgatcaggatgacaattacgatgctccggagagttaacatccacttttattccccgctcattaattggaatcttaacaacaaagtcatcatgtaaccgatagactgtcccataacttccgctacctattttatttttttcaatatcacgcatgcgaatatttttctgaaactccggcgagttaataaacgcctctattgccgctggttgtgatgtatctgtctgatcaatagcgccgctctcatcaccagacgccgtggcgggcgtggcgggcgtggtcaggaagtctatcaaacgatgctcaaaagcctcatagatcccattactacctgcttcgctcggcgtcaggtgatcattatctaaagcggcaagcgtaatttccccggaattataattaaacatcgtttcttttaaaaaatcgacgcaacgctcagagcactccgtctcggtcactaacattccatcataaaacatctgtagtagtaacatattttcttgatgtgctaatacctctacagtgtatttatctcttgtttcaggcctggaggcatcaataagtttaatatatccaagaagggggcgccatcgtgtacagtcttcatctcgcttcgaaaatggtcgtagcgagaaaggcttcgtaatatctggacgctcgtttttttggcacagtagattatagatttctctataatcagagattaaacttcgactggtaaatatattcctgaaaaaatctatgaacttctcatacgttgaaaaaacatgctctcttttatgatcaatgatatctcttaaatgtctttctgatatctggcaactatgatttccgatctgaaatgtaaacggcatatgtctcatcctctgaaaatttattataatatacatgcaaacatataaaaacctgatttgtaactactgtaatcacctgctttccaaaatttttcatattcagtattactctgcatcaataaatagagaaaaccttcagcgcctaaaaaagaaattatttttgttaagcatttgctggttaaaattacatgtccataacatcgctaataggtgaggtaaaccatttggatgaatattcaggcttcctacagaacctttatttgtctggtggaaggcgcatcgctatcgtacttgctgtccgtcccggtgtctctggttggatgaggcgaaccttacaccagctggtatactgcaccgtagggcctgtcccattagactctttgatttgccagtttggccctggggagtgctcaaaatcctcagggacttcgttaccgtgtggttttagaacgtcacctgccggagatagcggcggaaaaatagcgtgacacacggggccaggagtgggatataatttcagactaatttcgaataatgttgaaaagttgctgttaaccattgttcgtaaaagcaaaaaataagcaatgactataaggattaaagctatgggttttctttccggtaagcgcattctggtcactggcgtggccagtaaactgtccatcgcctacggtatcgcacaggcgatgcaccgcgaaggagctgaactggcgttcacctaccagaacgacaaactgaaaggccgcgtagaagaatttgctgcccagctgggttccagcatcgttttaccgtgtgatgtcgctgaagatgccagcattgacgctatgtttgcggagctgggtaacgtttggccgaaatttgacggtttcgttcactcgatcggtttcgcgcctggcgatcagctggacggcgattatgttaatgcggttacccgcgaaggctttaaaatcgctcacgatattagctcttacagttttgttgccatggcgaaagcctgccgcaccatgctgaatccgggttctgcgctgttgaccttgtcttatctgggagcggagcgcgccatcccgaactacaatgtcatgggtctggcgaaagcctctctggaagccaacgtgcgttatatggcaaacgctatgggaccggaaggggttcgcgtcaacgccatctctgcgggcccgatccgcacgctggcggcgtccggtattaaagacttccgtaaaatgctggcgcattgtgaagccgttacgccaattcgtcgcaccgtgaccattgaagatgtgggtaactcagcggcgtttctgtgttccgatctctcggcaggcatttctggcgaagtcgtccatgttgacggcgggttcagcattgcggcaatgaatgaactggaactgaagtaagcgcattaagtttattagcgggcggcacggctgtgctgccccattcccctcactcaccgctcatctcgttatatagcgttctgatatttgttatcacctaacaatctttcatccctttcccgcatacgccaggataatccagcataaacgatccgacgccgaatcattatcgatcgccatttcatcctcgggaaaccctatggaacaatgccgaaaagcgggtaaaagccactggtatcatgaaacacaatccactatgtcgtcacaaactccgctttcgctgatgccggaagccgcgtatgttaacgatcgatttttactggatttagcggtagcagaaaccgcgttgacgccttttgagtcatggttaaagccagctcgccagttggcggatgtcttatttccccgcacggttctcaacgaccggcttcatacgtttagcgcctatgaacgtatgagcaccgcccttaccgccgctcaggtatttggggttcagcgtttgtgccgccattatgccgcacgtctggcgccgctacccggccctgacgcctcaagagaaagcaatcaacggctggcgcaaattacgcaatacgctcgtcagcttgccggctccccctccgttatcaatacgcgagcccgcgaacagcttgcagaggtgggattaaccgcccgggataccgtactcatcaatcagatcattgggtttatcggttttcaggcgcgagtagcggcgatatttcaggcgttttgccgtctgcccgtgcgcgagctgcccggccaggagatgcagcgctttgccagggccgcgcggtttcaaaacccccagacgacatggcggcccgccgccagtctggtagaatatcctctcgcccataccaaagttcggcggcaatattcgtcttcacaatgccaaataatggcgccggtactcatgcgcgatccgtcttcattcgcgttactcgaacgcatactgaccagcacattacacactgcgtcgcccccttctttacttccacttatcacgctcctcacatcacgtatcaacggcagcgccgcctgctttaacgaacaggcaacccaacctggcgcgtggcgccgtgctgtcatcacgttacgctaggaagacgacgacatcgctcgttgggaacttgagcccgcgctgacacaggcgatacaatggctcaccagagcgcccgatcgctttagcgccgcgcattttttcccgctactcaccaggggagtttcatcggagcaggccattaatatgttaggctggtgtggcgtgtgcggatggttaaatcgtttaaaaatcgcgttgggcgaaacctattaactcatccattactgaaagagcgcttgctgcgccaggcagaatcgcgtaaaactgtcagccgctcttttggctacgaaaatagacgaatatgtttcaggacaacccgctgctagcgcagcttaaacagcaactgcattcccagacgccgcgcgctgaaggggtcgtaaaagccacggaaaaaggctttggcttccttgaggttgacgcgcaaaaaagctacttcattcctccgccgcagatgaaaaaagtgatgcatggcgatcgtatcgtcgcggtcatccacacggaaaaagaacgtgagtctgccgagccggaagaactgatcgaaccgttcctgacgcgctttgtgggaaaagttcagggtaaaaatgaccgcctgtccatcgtgccagatcatccgttgctgaaagacgcgattccctgccgcgccgcgcgcggcgttcagcatgagttcaaagaaggtgactgggcggttgccgaaatgcgccgccatccgcttaaaggcgaccgttcgttttacgccgatttaacgcagtacatcacctttgccgacgatcactttgttccctggtgggttacgcttgcccgccataacctggaaaaagaagcgccgaacggcgtagcgacggagatgctggacgaagggctggagcgccaggatcttaccgcgctgaatttcgtcactatcgatagcgccagcactgaagatatggatgacgcgctttatgctgaggaattagcggacggcagactccagcttacggtggctatcgccgatcctaccgcctggattgccgaaggcagtaagctggataacgccgcgaaaattcgcgccttcaccaactacctgccgggcttcaatattcctatgctgccacgtgagctgtctgacgatctgtgttcgctgcgcgccaacgaagtgcgtccggcgctcgcctgtcgcatgatcatcgccgcggacggcaccattgacgatgatattgccttttttgcggccaccatcgaatcgaaggccaagctggtgtacgacaatgtctccgactggctggaaaataacagcacctggcagccggagaacgaaggcattgcccagcagattcgtctgttgcaccgtatttgtctaagccgcagtgagtggcgtcatcatcatgcgttagtctttaaagaccgcccggattaccgctttgtgcttggcgaaaaaggcgaagtactggatattgtggcggaaccgcgccgtatcgctaaccgtatcgtagaagagtcgatgatcgccgctaacctttgcgccgcgcgcgtactgcgcgataagctcggtttcggtatttacaacgtacatacgggcttcgatcccgcgaatgccgacgcgctggccgcgctgctgaaaacgcatggtctgcatgtcgatgccgaagaggtgctgacgctggaaggcttctgtaaactgcgtcgcgaactggatgcgcagccctccggtttccttgacagccgcattcgtcgcttccagtcttttgcggaaatcagcaccgagccggggccgcatttcggtcttggtcttgaggcttatgccacctggacctctcccatccgtaagtatggcgatatgattaaccatcgcctgctgaaagcggtcatcaagggggaagctattgcgcgtccgcaggaagatatcacccagcaaatggcggaacgccgtcgcctgaaccgcatggcggagcgcgatgtcggcgactggttatatgcacgcttccttaacgataaggcggggacaaatacccgtttcgcggcagaaattattgacgtcagccgcggtggtatgcgtgtgcgactggtcgataacggcgctatcgcctttatccctgccccgttcctgcacgccgttcgcgatgaactggtatgcagccaggaaaacggtacggtacagattaaaggtgagacggtttataaagtgacggatgtcattgatgtcactattgcggaagttcgcatggaaacccgcagcattattgcccgaccggcagcgtaaccacgcttagctcgctcaacggcctttgctgagaaggcaaaggccgtttcttttcttcttctcccttccgtcatgctctaagtttaatcttattcaagcgccccatttcttgttatttttagctggcgactatgctttttccagaatctggattacatatgaatacatagataaaacaatatgttcagccataattacccttatttataacatggctaacctttcttttcgggcacctggcgcttaaatgggatggtacgcatgatgaaacagattcaggaacaaacggcgctaaatccccttcactctcactggcgtctggctgatgaccgcaacgtgctgtatctctccccgacaggtgaaacggatgcagaaaaaacggttgagctatcgccggagcaagccgggcgtatccgggaaataacggcgattacgtccagtctgctgataacgttgttgatagaaaaacaggttaccgctgtgcacctggtaggccgtaagattaataaccgtgaatgggctggcagcctggcaacctggcctgatacgcctgccgtcgcgccaacgcaggcgcaggaactctcttttgccgagcaaatcgtatcagaagccaactcagtcattgcgatactggatagtcggggaaaaatctgtcgatttaatcggttatgcgaagagtacacgggcttaaaagagcgagatgtaattggtcaaagcgtatttaaattatttatgagtcgccgggaggcggttgcctcccgacactacattgagaatttttttcgcaatggcaatgcctatgaaatcgaacgctggataaagactcgtaaaggccaacgtctgttcttatttcgtaataaattcgtccataacggtagcggaaaaaacgaaatctttctgatctgcgcaggcacggatatcaccgaagaaaggcgggctcaggagcgtttacgcatactggcgaatacagacaccgtcaccggcctgcccaatcgcaatgctattcatgaatttattaatcatgctattgcctcggctggcgagtcgcaggtgggtatcgtttatctcgatctggataacttcaagaaaattaatgacgcctatgggcatatgtttggcgatcagctcttacaggccgtttcactggcgctgttgagttgtctggaggaagatcaattgctggccagactggggggagatgaattcattgtcctcgttgcccatacgtctcaggccgcgctggaagcagtagcctcacgaatccttacccggctgcggcaaccgtttcgcattggactcattgaagtttacacgggatgcgccattggcatttcgttggccccccggcacggacaggacagcgaaagtctcattcgcactgccgacaccgcaatgtataacgccaaagaaggcggccgcggtcagttctgcgttttttcgccggaaatgaatcagcgcgtatttgactatcactggctggatacaaacctgcgaaaagcgctggaaaacgaccagttacttattcactatcagcccaaaattacctggcgcggcgaagtacgtagcctggaagcgctggtacgctggcaatcgccggaacgcggattaattccgccgctggagttcatctcatacgccgaagagtcaggactcatcgtcccgctgggccgctgggtgattctggatgtagttcgccagattgcgaaatggcgcgataaggggattaacttgcgcgtagccgttaacttttcggcgcgacaactggccgaccagacgctttttactgcgcttaaacaggctttgtacgatctgaattttgagtattgcccaatcgatgtcgagctaacggaaagctgcctgatcgaaaacgacacgctggcgctatcggttatccagcaatttagtcagctcggcgcccagattcatctggatgattttggcacagggtattcttcgctttctcaactcgcccggttccctattgatgccgttaaactggatcaggctttcgtcagagatatccataagcaaccgctgtcgcaatctctggttcgggcgattgtcgcggtggctcaggcgctaaatttacaagtgattgccgaaggcgtggaaaatgctaaagaagatgccttcctgacaaaaaacggcgtcaatgaacgacagggctttttattcgccaaacctatgcccgccgtttcttttgaacgctggtacaaacgttatcagacgaaaaaaatgcgttaatggcggcgataatagggagaacagcctgtgcagacaggcatagccctatttttcccttctcttttcagattaatttctgcatcatgaattgaaaccttttctgacattaaggatgacaaacatgtctgatatcgaagcacaacgaattgccgcacgcattgataccgtgctggatatccttgttgctggcgattaccactcggccatcaataaccttgaaatattgagagcagagctgttagatcaggttaaagacggtatctcgccatcccaggctcccgggtcgccctgggaaatctgatagcgattatttgtccgggatggccgttagcccttcccggctctctgactgtctgttgactcctcttaacgaataaaattaatactatgaactcccgacaacaatcaattttgcaaatggtggttgataaaggccagatgagcgttgctgaactggcgaaaattaccggcgtatctgaagtcacgattcgtcaggatctgaataccctggaaaaacagagctatttacgccgtgcgcacggtttcgccgtttcgcttgagagcgatgacgtagagactcgcatgatgacgaactacacgctaaaacgccgactggcggagttcgccgcctcgctggtcagtcctggggaatccgtttttattgaaaatggcagtagcaatgcgctattggcccggacgctggcggaacaaaaagatgtcacgatcatcaccgtgagcagttatatcgcgcatctgctcaaagaaaccccttgcgaagtcattctcctcggtggaatctatcagaaaaaaagtgaaagcatggtagggccgttgacgcgacagtttatccatcaagtgcatttcagcaaagcatttatcggtattgatggctggcaggctgataccggctttaccggacgcgatatgatgcgatcggatgtggttaacgctgttctggaaaaaggctcagaagcgattgtcctcaccgacagctccaaatttggctgtgtgcatccctatcccctgggcccgctctctcgcttccatcgtgtcattacggattccaaaatttccgccagcgatcaaatgcagttagagcatgcagggctgctagtcaatgttattggctcatccgtttaaaatatttcccgatggtttgccctctatggcaaatcatcctctctctaagacttttctgacatcccaattaagactatttacctgttgtaacgagcgtaacgtcgtaaaattaatattagcgaaataacaggaagtgactatcacctgcgtgatatacccctgcgcaatcaggttttacggaaaatctcttaacatgttttattttaactatagttatagtgagcttaattccgtgaatcgttaattcaggagagagtattatgtttatgatgagcaaaaaaatggccgctgctgtgctggcaatcaccgtagcaatgtctctgagcgcctgctcaaactggtccaagcgcgatcgcaacacggctattggcgcaggtgcgggggcgttaggcggcgcagtgttaacggacggcagtacattaggcaccctgggcggcgcggcggtcggcggcgtgattggtcaccaggttggaaaataatccagacgtttaaatattgaacggctcaaaataatacgtttattcttttcaggtctggattacaaaaatagacaaagttgacttttacgccacggcaatttacaaccgtggcgttttcattagccgccagctaattttactttcattcctttagcttccagcaatgattttatcaagtcgcgtttatcaccctgaatttcaataatcccttcttttactgccccgccacagccgcattttttcttcagttcagccgccagtttggttaattccgcatcattcatctcgataccggtaatcaaacatacgcctttacccttacggccactggtttgacgctgaatgcgaacgataccatcccctttgggacgaaccggcgccgttttaggttcttcaatgcgccccgtctgtgttgaataaaccagacgactattggaatcgctcattatgcctcccgtttcagtgacgcgttaatatccttcagcgtttgcgccggatctaccgattgcgtaaccgggcggccaatcaccatatagtcgacgccagcggataatgcctgttcgggcgtcataatgcgtcgctggtcgcctgcctcgctgcctgcgggccgaatgcccggcgtcaccagcttaaatgcagcgccaaaggcctgtttaaatctgacagcttcctgagcggaacagaccacgccatccagcccgcattgctgcgtcaggcgcgccagccgctccgcatgttccgccggtgacaacgtcacgcccagatcgtgtagatcgctggttcccatactggtcaacacggtcacggcaatgagcaacggcgcatctttactgaatggcgccagcgcgtcgcgcgctgcggccatcattctcgccccaccagacgcgtgaacgtttaccatccaaacgcccaggtctgccgctgcggcgactgcccgggccgtggtgttgggaatatcatgaaattttagatcaagaaagacatcaaacccacgttgctggagatcccgaacgagttgtggaccaaacagcgtgaacatctctttgcccacttttaagcgacaatcgcgaggatcgattttatcgacaaacgccagggctttatcgcgttcatggtaatccaacgccacaacgacaggcgattcagtaatagcgcaggaagaagatgaagcagtaaacgtcatgaccagaccttcttgatgatgggcaccggaagtggcgcaaattggataaacggcgtgcattctacctgcggcgcagggaaattaacaggttcgattgacaacctgataagccctggccgccgatgccagcgtcgtttcttgtcttatgtcattaagtatgttgtaactaaagtgaggttttttttatatactactgcccatcaagtccgcgaataggtttaatggtcgaccatgcccggcaggacggacagtgccagtacaaggtataggcggtaaaaccgcatttctgacaacgataccgcggtttactgcgcacctgctcgccaaccatatcacgcagtaccatcaggctttctttcgctcgcccttcttccgcctcattgagatggtaatccatcagcttatggaacacccgcatggtaggatgtcgctgtagctgacgcgtgatatagacttgagctgcgtcactaccttcacgcgcttccagaatatcggcaagcattaactcagcgccagcaccggtattctcctcaacggcgcgacgtaaaaactccgcccactcggcatttttaccgagctgttgataacaggtttgcaacatctccagcgtttcgctgaccagctctttatcctgaacgatcacacgttgcaggctttcgaccgctttggcgtaatcccctctcgccatataaacgcgccccatcatgatagacacccgggcgctatttttatctgcggcggcaccttttttcagcaacgccatcgcgcgatccatgtcgtcgttgcccatctgctgtaacgctaactcacagtaaaagtgggcgatttcgatacgctgtttatctttgcccagtttcaccagccgttctgctacttcgatcgccttttgccagtcgctggttagctgatagatttgcaagagctgctgtaacgcgcctacgcgaaattccgtttcgtcggtaagttggttaaacatatcttccgcgcggtcatataaaccggcggccatatagtcgcgccccagttgctgaacagccagtaaacgctgttcataggtcaatgaagcgctttccatgagcgtttgatgaatacgaatggcgcgatcgacttcgccgcgagagcgaaacaaattaccgagagtgagatgagcctcaacggtgccggtatcctctttaagcatatcgaggaacagatccaccgctttatcttgttggttactcagcaggaagttaacccctgcgacataatcgcgcgacaggcggttagcttcatcctgttttgtttgttgcgcacttctgcgacccatataccacccataggcagcggctacaggcaacagcagaaataacaactccaacataaatgattattcctttacaaccgacgaatcggcagggaccgcaacgtcggttgctggcgagagcttgttttccagtcgtttaattttacgttcagcgcgggcaagggaaacgcggatccgcagccagaacaggccgcaaatcagccagccaatcgcaaaaccgacggcgaacagcacagcaagcaacgtggagatacgatactccccttgcgccagcaggtagttaaacgtcacctgttgatcattctgcgcgcccagcgtcaccgaaataacaaaaatcgccaataccagtaagaaaatgagtaaatatttcacattacttcccgttatgtggtttgcgcgaataaatcgtgtccaacttaccgcatccagccttctaaattaccattttcccgcctcgcgcgaaatggaaatgcgcccaccatcagatgatttaagggcaatagtcagaaaatcaaccgttgtcagctttcctgctcgcgttcagcaatttcttgcgcttcttcgcgaggcggcataagcggcccgcaaattcgctgcgccagccaggtcgccagggtaactaatagccaggagatgagcgtggcgaccactaaatctcgcggccagtgcattcccagaagcaaacggctgcccattacgccggtcgcccagactaacaaaaacgcgatggtgaaagtccgtctgcgcggccataacagacccacggccaaaagcgcccagctcgctgcaaacatggtgtgtccggagggaaacgcaaagcccgtctctttttgccagtgctgacgcaggaaaacggggatgttctgttgcccggccaactgctctttcactaaatgtccgcgttctgtacgctttaaagtgtagaactcatcgacgggaatatggtgcgttttttcaagccagaccacaaatggccgcggctcctgtacgcgctcctttacccatgacttcacgccctgcccgacgataatcgccccaccgagaatcgcaaacagcataatggcggcgcgcaggcgaaatcgcaggcaccataagaaccatccacaaagaatcacatgcgtgataacgccccagggtttggtcacggtttccgttatccagaatagcgtttttagccaccagacctgatgtcctggctgccactgccagcctgatacccatacggcaagcggcatgataagcaacagggcggcgcctgccgcggtgcgcctcgcaattgaaagcatggatgctccttttataagtaagtatcacaatcataactgaaaattctcgccggactggaaaattgacaaatttgtgccattcctgagcaattacgtggtagtgattaggtgatgaccgccgccttatggcaaaatagcgggatacaggccaacaggcgacgacaccgcaggcgtcagcataatctggagaaatacatgcagcttaaacgtgtggcagaagccaaactgccaaccccattgggtgactttctgatggtgggatttgaagaactggcaaccggacacgaccatgccgcgctggtttttggcgatatttcaggtaaaacgccagtactggctcgcgttcattccgaatgtcttaccggggacgcgctttttagtctgcgctgtgattgtggttttcaactggaagccgcgctgacgcatattgcggaagaaggacgcggtattctgatttaccaccgtcaggaaggccgcaatatcggcctgcttaataaaattcgcgcttatgcgttacaggatcaaggctatgacacggtggaggccaatcatcagctcggctttgccgccgatgagcgtgatttcaccctgtgcgcggatatgttcaaattactcggcgtggatgaagttcgcctactgaccaataatccgaagaaagtcgaaatactgaccgaggcgggaattaatatcgtggaacgcgttccgctcattgtgggtcgtaatccaaataatgagcattatctcgatactaaagcggccaaaatgggccacctgctaagcaagtaagccaccggtattaaagcgcgggcctgcctgtttacggcaggcccgataaacggctttagttcagcatatttctaatgacatagtgcaatatgccgtcattctggtagtaagtcagctcggtggcggtatcaatgcgacagcgacaaggcaccgtttctttgctgccgtccgctctcgttaacataaccggaatggtcgcgccagggcgcagattttgcagatccgcgatatcaatcacctcttccccggtcagtcccagcgttttacgcgttacgccctgtggaaactccagcggcaggatccccatcccaatcaggcttgagcgatggatacgttcgaacgactcggcgatcaccacgcgaatacctaacagccgcggaccttttgccgcccagtcacggctcgatcccgacccatactctttcccggcaattaccgccagcggcgttttttcctgctggtagagcatcgcggcatcataaatcgacatcgcttccgtacccggcaaatgccgcgtcatcccaccttcgacgccgggcagcatttcgttgcgaatacgaatattggcgaacgtaccgcgcatcatcacttcatggttgccgcgccgtgatccataggagttaaaatccttccgctcaacgccgtggttttgcagatagcgtccggcgggactgtccggcttgatactgccggccggggaaatatggtcggtcgtcaccgaatcgcccagcatcgccaggatacgcgcgccgtggatatctttgacgggtgcaggctgggcctgcatttcatcaaagaaaggcgacaggcggatataggttgaatccgactgccagccgtaggtatcggacgattcaacctgaatcgatttccattcttccgtgccctcaaacacttccgcatactctttacggaacatatccgatgataccagttcaacggcgcgggcaatttcctgcgccgaaggccagatatccttcaggtataccggatcgcctttacgatcgtaccccagcgggtctgtcgcgaggttaatattcatgtttccggccagcgcatacgcgaccaccagcggcggcgacaccagccagttcgttttcaccagcggatggatacgcccttcaaaatttcggttaccggaaagcacggcccctaccgtcagatcgccttttttaatcgcggtctcaataggctccggcaacggaccggagttcccgatacaggtcgtacagccatagccgaccaggttaaaaccgagctcatccagataaggcgtaagtttggcctgcgccagatagtcagataccacttttgaccccggcgccagagaagccttgacccacggttgacgcttcaaccccagcgttactgcctttttcgccagtaatcccgccgccatcagcacgctgggattcgaggtattcgtacaggaggtgatggcggcaatgacgacagcgccatccggaagctgatatggctgtccgttcatcgtatagtcaaccggctggcgatctctttgcgcggtattcagctccagctcggcgctggcggcaaaggctttcggcacatcgcctaacgccacgcgatcctgcgggcgtttcggcccggccaggctggcctcgacatcgcccatatccagttccagcgtactggtaaataccggttcgtcaccgggattacgccacattccctgcgccttcgcgtaggtttcaaccagctcgatcagatcgtcgctacgtccgcttaatcgcatatattccaaggtgatggcgtcaatggggaagaaaccacaggtggcgccatattccggcgacatattagcgatagtcgcgcgatccgccaacggcagcgaatccagaccgtcaccataaaattcaacaaatttacccacgacgccatgcttacgcagcatttgcgtgacggttagcaccaggtcagtggcagtgatcccctcccgaagtttaccggttaacttaaagccgacgacatccgggataagcatcgacacgggctgaccaagcatcgccgcttccgcttcaataccacccacgccccaccccaatacgcccagaccattaatcatggtcgtatgggagtcagtccccaccagcgagtccgggtaagcaatccactccccgtcctgtaattcgctccagatggctttacccaggtattccaggttaacctgatggcaaatgccggtgccgggcggcaccacgctgaaacggctgaatgcctgctttccccatttcaggaacatataacgctcatggttacgttccatttccagccgcacgttttcttcaaacgcatcatcatcgccgaaatgatcgaccgtcacagagtggtcaataaccagatcaaccggcgataacgggttcactttcgacgtatcgccgccgaggcgtttaacggcttcacgcatcgccgccaggtcgacaacggcaggcacgccggtaaagtcctgcatcaggacacgggcgggccgccaagcaatttcacgatcggcatgggcatttttaagccaaccggccagcgcctgaatatcttcatcagtcacagattcgccgtcctgccagcgcaacaggttttccagtaacactttaagtgatttgggcaaacgggcgatatcgcccagggatttggcagccagcggcagactgtagtaatgatacgttttatctttggcctgcaatgtatccttactggcttctcgtagggttgacgacatagctcctcctttaatgacagggttgcgttaccctgattctccacagggttgtattaaagataacacaaacaaaatgtaacgttttgataacaacccaaattgctaaaagaggagaaacctaacaggcgaggaacgaagatgaaaaagcccgataaataacgcattatcgggctttgacgagattagacggcaatccagattaactcggcccagaacagtagcgataatataaacgcgccagtccatgaccaatactttatatttgacgttaacataggcaacaccaactgtgtttaatcaatactgagaagcgctcagcacacggttgctgcggtgtaataagacagcgttaataaaacagtaacgccaataaaaagacgaatattatttttgtgacacctcgtcagcaaaagcatcaataaatgcccgctgctgcggtgtgagcgtccagtgttgcggaacagaccgaaaaacggtcgtatccggggtgttatcatcgtcaccagattgaatcgggggcgcgaccacgcgctcgcgttccgacgtaatgctcacttagccccaccaatgccagataacaagcgctaccactacccagaacaacgcagaacccacaaaaaccgccagccatgctttacgtttgagctcagggtcgcggcgcggttcctggttttcagaaggcattactaacctcatgctatcggtatcacttatcatttcagcaccaaacaatcggtacaattaatcatcagatgagacaaatcctaaataaactttagtcaaaaatccagtcaatttacgaatcgttgccagtgaataaatcaatcttttgactcaagataactatttggaaaaagaaactggcgggacgggtaattcaacactattttgctgatcattacccgtaatacttcgagggatattgcaaaaggcggctttgtctgccatgccactacgacacaaacccacggtgatattacttttcaggcagctttatatcctgaaacatcgcttcaatttcttcattagaacgcaacgccaccgccgtatccaccacatcacgcgtcagatgtggcgcaaaacgctggataaaatcatacatatagctgcgtaaaaaagtactacggcgaaaaccaatttttgtggtgctgtggctaaaaatatcgtgcgcgtcaatccgcactaaatcaggatcggtaagcggatcgaccgccatgctggcaatgacgccaacgcccagccccaacctgacatacgttttaatcacatccgcatcggttgcagtaaagacgatccgcggcgttaaccctgcgcgattaaaagcggtatccagttcggaacgcccggtaaagccgaaggtatacgtcaccagcggatactgcgccagcgcttcgatcgttatggaagacgttgccgccaatggatgatccggcgtcaccactatcgaacggttccagtgatagcatggcaacatcaccagatcgtcatataaatgcagcgcttccgtggcaatcgcgaaatcggcgttccctttcgataccgcttccgcaatctgcgttggcgacccctggtgcatatgcagcgaaacgcgcgggtaacgctcgatgaagcctttaatcacgcctggcaatgcgtaacgcgcctgagtatgggtagtggcaatatagagcgagcctttatccggccaggtgtgctcgccggcgaccgacttaatggcatcgactttggaaagcacctcacgcgcaatacgaataatctcctgacctgcgggcgtcacctgagtcagatgcttaccactgcgggcgaaaatctggatgccaagctcatcttccagcatcctaacctgcttgctgatccccggctgggaagtatacaacccctcagcggtagaggagacgttaaggttatgattaaccacttcaacaatgtaacgaagctgctgcaatttcataatacatcatccagattagcgccatcaggccatcgtttatctgcagacatcattgggctgctaatacgatttaataataaaaaagatgttaactataaccactatatcatttatatctgaactgtatagccagcgcgataaaataataagcccgctatacccaaaataattcgagtgattaaaggcaacaagcgagtgagttccctggagcatagataaccaggggactggggtgagcgacaaatcagccgggagcagatttgaacgtcgcgtgcgacggcccgtcagggcgaggcccatagatgggccgagtaatccgtagccaacacataagccacttgaaatatgaaggggatataaaaaagggccgcttacgcggcccgcttgactacagtggcgacaggccggggttatttcttaccttcaacccacttgccgtcgacgaagaacgctgaccatcccgtcgccttcccgtctttttccgccgcaacgtactgctgttttgttttgcggctaaagcgaacaacggttttattgccttctggatcctgctgcggcgcatccgccagataacgcagtttttccggcaggcgatcgcggaaccggtaaagctcctcgactaatggcgcgcgcgtttcacgtgatttcgggaacgtattggccgccaggaatatccctgcggcgccatcgcgcagcacaaagtacgcgtccgatttttcacacggcagttccggcaatggaacaggatcttccttcggcggcgcaacttcgccgttacgcaagatcttacgggtatttttacattcgtcgttagtacaggccatgtacttaccaaaacgccccattttcaggtgcatttcggaaccacatttctcacactcaacgatcgggccgtcataccctttgatgcggaactcgccttcttcaatctcgtagccgtcacaggtcgggttattaccacacacatgcaatttacgcttcggatcgatcagatagctgtccatcgccgtaccgcacttctgacagcgacgtttggcgcgcagggcgttggtttcggcgtcgtcgccttccagcacgttcagaacttcattttccggcaccaggttaatggtcgttttacaacgctctttcggcgaaagcgcataacctgaacaaccaaggaaaacccccgtactggcagtacgaattcccattttacggccacaggttggacagtcgatgctggtcagcaccatctggttaggacgcatccccccttcttccggatctttctcggctttatcgagctgctgagtaaaatcgctgaagaagttatccagcaccgctttccactcggcctggtgattcgcaacctgatccagactatcttccatctgcgcggtaaaatcgtagttcatcaattcgcggaagttttcttccagccggtcggtgacgatttcacccattttttccgcatagaagcgacggttttcaacgcgaacatagccgcgatcctgaatggtcgagataatcgacgcataggtagacggacgaccaataccgcgcttctcaagctctttaaccagagaagcctcgctgaaacgggctggcggtttagtaaagtgctgagcaggcgtcaattcaagtagcgtcagcgcatcgcccttattcacgacaggcaatgtgcgatcttcatcgcctttacgcagcgccggcatcacttttgtccagccgtcaaagcgcaaaatacgcccacgcgctttcagacggaattcgcctgcgccaacggtaagcgtagtggagtcatattgtgctggcgtcatctgacaggcgacaaactgacgccaaattagctgatacaacttctgcgcgtcagcctccatgtctttcagcgactccgccatgacagcaacgtcggaaggacggatcgcttcgtgcgcttcctgagagttttctttgctggcgtattggttcgggttatccggcaggtatttcttgccgaaattatcgccaatatagccgcgcaccatgttgaccgcatcctgactcaggttggtggagtcggtacgcatataggtgatgtagcccgcctcatacagacgctgcgccatcatcatggttttcttcacgccaaagcccagccgggtgctggccgcctgttgtagcgtggaggtgataaacggcgcgccaggtttgctgctggtcggtttgtcttcacgctccagtacgctatagcgcgctttttccaacaagctgacggcggcaagcgtctgctcgcgatttaccggccggaatggcttgtcgttctgatgcgtgacctgtagcggtagtgcctcgccagacggcgtcgtcgtattagcgtcaatctcccagaactcttccggaacaaacgctttaatctcgcgctcgcgctcaacgaccagacggaccgcgacagactgaacgcgacctgccgacaaaccacgggcgatctttttccacagcagcggcgagaccatatagcctaccacgcggtccataaagcggcgcgcttgctgggcgttgaccctgttaatgttcagctcgcccggctgttcaaacgcctggcgaatggcatttttggttatttcgttaaagactacgcgactgtagcgcgcgtcatcgccgccgatcacttcccgcaggtgccatgcaatggcttccccttcgcggtcaaggtcggttgcgagatagatgtggtcggctttttccgccaactgtttcagttcagagacgaccttctctttaccgggcagcacttcatagtgcgcatcccagttgtgccacgggtcaacccccatacggttgacgagagcgccacgttcatcctttttgggctttttagccgttttggtggaggtagagtcggcgctctttttagctgctgagccactggtcggcaaatcacggatatgacccacgctggatttcaccacgtagtcattacccagatacttgttgatcgttttggcttttgccggggactcaacgatgacaagagctttacccatattcacctttacctaagttgattcttccaggaatgcgtcgcacgttgattcaccttccactggcgacgagacaacgatatatggtctctgcgtctgcggatatcaaccccttgtactggctttgtgtacgaaatgtaaccctcaggtgactgagttaacaggcttttttgcacacacgcgctatagcacgacggaattttggtcgaatgtcaagcaattctgttgccagattgacgaaagcgtcacactgtacctgataaaattcgatacgcaactttattagcatgcaaaaacaaatcttgccagtgaacgcaacatgacaaatccatcaatttcctgtgagaatatttgcccatcagaagtgctcagcgtagactaatctccttgtttaaggagtaaaaaatgcataaagagacgcaacctatcgatcgcgaaacactgttgcttgaagccaacaaaattattcgggaacatgaagacacgatggcaggtattgtcgccaccggcgtaacgcagagaaatggcgtgctggttttcagcggcgattactttttagacgagcaagggttaccgacccctaaaagcaccgcggtgtttaacatgtttaaacacctggcgcatgtgctgtctgagaagtatcacctggttgattaatccatgccggatggcgctgaatgccatccggcaatagcggtttacatcaacggcttttgtccacgctgccaccagcgcagcagcagccgatccgcgctttccgccgcgctgccggtaacacgatcgatcagttttttacgctgcatatagcgcacattcagcacctcgcgcccttccatcaggccgaggataacctcatcgctggtgttaatctcatcaaccagtcccttctccagcgcctgctgaccgtaccagtgttcgcccgtggcgacctgttcaatgtccagagccggacgcatccgctgcacaaactctttgaacagatggtgcgtttcgttgagatcttcacgaaacttctgccgcccttcttccgtattctcgcctaacaaagtcagggtacgtttgtactgccctgcggtatgcagttcaatatcaatgtctttacttttgagaaagcggttaaagttcgggatttgcgcgacaacaccaattgaccccacaatagcgaacggcgccgcgataattttttccgccacgcaggccatcatgtagcctccgcttgccgcgactttatccaccgtcacggtcagcggaatatttttatcgcgcaggcgctgcaattgcgatgccgccaggccatagccgtgcacaacgccaccggggctttccagacgcacaaccgcccgatcgccgggtttcgccactgccagcaccgccgtgacctcttcgcgtaacgcattaacttcgtgagcgtccatactgcctttgaaatctatcacccatacgcgcggtttgtccgatgtcgcaatgccccccagcttcgctttcgctttggcggctttcgcctcctgcttatgcttttttttctgcgctttatgccacagtttttgctgatggccatccatcaacgccgcagcaaggtcatccttcatctcctgatactgctcactcaaattggtcacgcgcagctcgccgcgctgacgtttgcgttgcgtagcattcacgatcagcagcacaatgacggcaatggccaccacaacggtgacgatttttgccaaaaataagccatattcagacaacaattccacgactcccaccttgattaaataacgcgacttgcgctcagtgtacaacaggcatcgaagtcagtctctcttcatccgtatgcctgttgaggaagaaaaagtatgacaagacgttcattttacggcgttatcgcccctgtctgattgaaaaaaaaggcgctttcaggcataaacccgaaaagttaacgcgaagataagacaacctggcaggacggtgcaccacaccgttgaggagtagccatgcattaccaaccgaaacaagatctattgcaaaaccgcattattctggtcactggtgccagcgatggcattgggcgggaagccgcgctcacgtatgcgcgttacggcgcaacggtgattctgctgggacgcaacgaagagaaactgcgtcgggtcgcgcagcacattgctgacgagcaacatgttcaaccacagtggtttacgctcgatctgctgacctgcaccgctgaagagtgccggcaagtggccgaccgcatcgccgcgcactatccccgcctggatggcgtcctgcacaatgccgggttactgggggaaatcggcccaatgagcgaacaagatccgcagatctggcaggatgtcatgcaggtaaacgttaacgccacctttatgctcacccaggcgctgttaccgttattattgaagtccgatgccggctcgctggtctttacgtcatcaagcgttggccgtcagggacgcgccaactggggcgcctatgccacctcgaagtttgctactgaaggaatgatgcaggtgctggcggacgaataccagaaccgttctctgcgtgttaactgcattaacccgggcggcacgcgcaccagtatgcgcgccagcgcctttccgacggaagatccacagaaattaaaaacgcctgccgatattatgccgctttacctgtggcttatgggcgacgacagtcgccgtaaaaccggtatgacctttgacgcccaaccgggccgtaaaccaggaatcgcccaatgagtgatgaacgttatcagcagcgccagcagaaggtaaaagatcgggttgacgcccgtgtcgcccaggcacaggaagagcgcggtattattatcgtgtttactggcaatggtaagggcaaaaccacggcggctttcggaactgccgcccgcgccgtaggacacggtaaaaacgtaggcgtggtgcaatttattaaaggcacctggcccaacggcgagcgtaatctgctggaaccgcatggcgtcgaatttcaggtgatggcaacgggatttacctgggagacgcaaaatcgcgaggcagacaccgcagcatgtatggccgtttggcagcatgggaaacgaatgctggccgatccgctgcttgatatggtagtgctggatgagctgacctatatggtggcgtatgactatttaccgctggaagaggtcataagcgcgctaaacgcgcgccctggtcaccagacggtgattattacaggtcgcggctgtcaccgggatattcttgattttgcggataccgtcagcgaactgcgtccggttaaacatgctttcgacgcgggcgtaaaagcccagatgggaattgattattaaccgtaggccggattaaggcgtttgcgccgccatccggcacaaaccctcttgtctgatgactctcggcctataaaccacggtagagattacccgttgttattacgcccaccggagcggcgtccgccagctatctggctgtggcgttttaccgcccgacggatctggttcgctttcatacgacgacggtctttttcgacggcaaccttcgacgaggtttccggcgggagctctaccagaccacgcagatagttcgtttgcgcgaggtcgagctcagtccagccgccgcgcggcaggcctttcggcagcgggatatcgccgtaacgaacgcggatcagacggctgacctgaacgcctaccgcttcccacagtcggcgaacttcgcggttgcgcccttccgtcagcgtcacgttataccactggttaatgccttcgccgccgctgaatttaatggtcttaaatgccgccggaccatcttccaactgtacgccacggcttaaatcacgcagtttcgattcatccacctgaccgaacacgcgcacggcatattcacgttcaacttcgcgactaggatgcatcaggcggttcgccagttcaccgtcggtggtaaacaacaatagcccgcaggtgttgacatccagacgtcctaccgcaatccaccgcgcgccgcgcagtttcggtaagcgatcaaaaacggttggccgcccttcagggtcattgcgggtacacagttcaccttctggtttgtaataggccagaacgcggcaaatttgttccgccgactctttcaccgaaatcaggtgaccgtcgatacggattttcaaaccgggagtgacttcaacacgatcgccaagcgtggcgattttaccgtcaacgctgacacgtcccgcttcaataatggattcgatttcacggcgagagccgtggccagcgcgcgccagcactttttgtaacttttcgctcatagagcttccttcaggtgtcgccttcacaggcgtcgaacaggagaatgaacggcgcgttgccgcgccattttaaggccgcgtagtatacaggcttacgcccttataagaaaggtgtaacgtcgccgacgccttcgcgcagcaccaccggggagtcattggtcaaatcgattaccgtggtaggctgttgaccgaggtaaccaccgtggatgatcagatccacctgcttctccagccgatctttaatctcctccgggtccgactcggtaaaatcgctgccaggcagcatcaacgacgtcgagagcatcggttcgcccagcgtatccaataacgccagcgcaatcgggtttgacggtacgcgcaggccgatagttttacgcttttcctgcaacagacggcgcggcacctcttttgtccccttcaggataaaggtgtaattacccggcgtattgtttttcatcagacgaaatgccacgttgtcgacgtaggagtaggtcgacaactcggacaaatcgcggcacatcagcgtgaagttgtggccgtccggcagatgacggatgcggcaaatgcgctccattgcgcctttgtcttcaattttacaaccaagggcatagccggaatcggttggataaacaataacaccgcctttacgcacaatgtcgacggcctgattaatcagccgttgctgtgggttatccggatggatataaaaaaactggctcatacttccctcactgtgatatttgcggctgttcccatgcctgccatacgccttcaacgccagcgggcagccagagtttacgccccaactcaatccacgggcagggctgatggaaatcagatccaagcgatgcccataaatgatgctgacgcgcaagcgtcgccagttgggtgcgttcattgggtgattgttggcactgcgccacttccatcgcgtcgccgtgatggtcggcaaaatgcgccactaatcttttcagccacttagcgctaaggtcgtagcgtcccgggtgggccaacaccgccttaccgccagaatgatgaatgacatcaatagcttgttctattgtacaccactgcggcggaacgtaaccggttttcccacgcgcgagatattttttaaaaacctccgccatggtcgtggctttgccgcactccaccagaaagcgggcgaagtggccgcgcgtcaccgcgccgccattggccagtctcaatgccccttcccacgcgccgggaatatgggctttttccagacgctccgcaatgagccgaccacgcgcctgacgccgatgtgtctgctgcgctagaaaatcgcgcattgccgggtgcgcaatatcaatattcagacccacaatgtgaatctcatgattctcccagaccgttgaaatctccacgccgggaatcagattcagggccagcccgcaacgtgaaatttcttctcttgccgcaggaatcgcagctgtggtgtcatgatcggtaatcgccagcgtgccgactcgcatctctaccgcacggtgtactaatgtttctggcgtcaacagtccatcggacgccgtggtatgactgtgcagatcgtaaatcactgcgtaattcgtgtcgctcaaggcggctcccatagagataaaggtatgtcatgtacatcataacggttccggcaaatatactgaaataggtgttgacattattccattgaaccagttaactagtacgaaagttcacatgaagagggtatctaaaatggcagcgacatttgcattacacggttggtggcgcacttcctgatagcgggcggtgtatgaacagctgtaatcagccaaacgatacccggcccgcctgttaagcgggcttttttttgaacaaaataatgagaataaccatgcaaacaccaaaacccacgctcgaactattgacctgcgatgccgcctaccgggaaaacccaacggcgctttttcaccaggtctgcggcgatcgcccggcaacgctgctgctggaatccgcggatatcgacagtaaagacgatttaaaaagcctgctgctggtagatagcgcgctgcgcattaccgctttaggtgacactgtcactattcaggcgttatctgataatggcgcctcgttattgccgctactggataccgccctgcccgctggcgtggagaacgaagtcctgcctgccggtcgcattctacgctttccgcccgtcagcccattattagatgaagacgcccgtttatgctctctgtcggtatttgatgcgttccgcctgttacagggagtggtgaacataccgacgcaagagcgggaggctatgtttttcggcggtctgtttgcctacgacctggtcgctggctttgaagcgctgccacaccttgaggctggcaataactgcccggactactgcttttatttagcggaaacgctgatggtgatagatcatcagaaaaaaagcacccgtattcaggccagtctgttcaccgccagcgacctggaaaaacagcgcctcaacgcccgcctggcgtaccttagccaacagttaacccagcctgcgccgccgttgccggtgacgccggtgccggacatgcgctgtgaatgcaatcagagcgatgacgcgttcggcgcggtggtacgccagttgcaaaaagccatccgcgcgggcgagatatttcaggtggtgccgtcgcgccgcttttcactgccctgcccgtcgccgttggctgcctactacgtgctgaaaaagagcaaccccagcccgtatatgttctttatgcaggataatgatttcacgcttttcggcgcgtcgccggaaagctcgctgaaatatgacgccgccagccgtcagattgagatttaccccatcgcgggtacccgtccacgcggtcgccgcgccgatggtacgctggacagagatctcgacagccgtattgagctggacatgcgtaccgaccagaaagagctttccgaacatctgatgctggtcgatctggcgcgcaatgacctggcgcgcatctgtacgccgggcagtcgctacgttgccgatctgaccaaagttgaccgctattcgtacgtgatgcatctggtttcccgggtagtgggcgaactgcgtcacgatctcgacgcgctgcacgcctatcgcgcctgcatgaacatgggcaccctgagcggcgcgccgaaagtacgcgccatgcagttgattgccgatgcggaaggacagcgccgcggcagctatggcggcgcggtcggttacttcaccgcccacggcgatctggacacctgtattgttatccgctccgcgctggtggagaacggtatcgccaccgtacaggcgggcgccggaatcgtgctggactctgttccgcagtctgaagccgatgaaacccgtaataaagcgcgcgccgtattgcgtgctatcgccaccgcgcatcatgcacaggagaccttctgatggctgatattctgctgctcgataacatcgactcgtttacctggaacctggcagatcagctacggaccaacggtcataacgtggtgatttaccgtaaccatattccggcgcagacgcttatcgatcgcctggcgacaatgaaaaatccggtgctaatgctctcccccggtccgggcattcccagcgaggcaggctgtatgccggagctgctgacccgactacgcggcaagttaccgatcatcggcatttgtctggggcatcaggcgattgtcgaagcttacggcggttatgtcggtcaggcgggagaaatcctgcatggcaaagcctccagcattgaacatgacggtcaggcgatgttcgccggtctggcgaatccgctaccggtcgcgcgttatcattcgctggtcggcagtaatgttcctgccgggctaaccattaacgcccatttcaacggcatggtgatggcggtacgtcatgatgcggatcgcgtttgcggttttcaatttcatcctgagtccatcctgacgacacagggcgcgcgtctactggagcaaacattagcctgggcgcagcaaaagctggaaccgaccaacaccctacagccaattctggagaaactctatcaggcgcaaactctgacgcaacaagagagccatcagttgttttcggcggtcgtccgcggcgaacttaagcctgaacagctcgccgccgcgctggtgagcatgaaaattcgcggcgagcatcccaatgaaattgccggcgccgccactgcgttgctggaaaatgccgccccgttcccgcgcccggactatctgtttgcggatatcgttggtaccggcggcgatggcagtaacagtatcaatatctctaccgccagcgcctttgtcgcggcggcctgtggactgaaagtggcgaaacacggcaaccgcagcgtatccagcaaatcggggtcatccgatctgttggcggcgttcggtattaatctggatatgaacgccgataaatcacgtcaggcgttagatgaactgggcgtctgtttcctgttcgcgccgaaatatcacaccggattccgtcacgcgatgccggttcgccaacagttaaaaacgcgaaccctgttcaacgtactcggcccgctgatcaacccagcgcatccgccgctggcattgattggcgtctatagcccggaactggtgctgccgattgcggaaaccttacgggtactgggctatcagcgcgcggcggtggtacatagcggcggcatggatgaggtttcgctccatgcgccgacgattgtcgcggagctgcatgacggcgaaattaaaagctatcaacttacggcggaggattttggcctgacgccttaccatcaggatcagttggctggcggcacgccggaagaaaaccgtgacattctgacgcggttattacaaggtaaaggcgatgccgcgcatgaggccgccgtcgccgccaacgtggcgatgctgatgcgtctgcatggtcaggaagatctcaaggccaacgcgcaaaccgtgcttgatgttctgcgcaacggcaccgcatatgacagagtcaccgcactggcggcaagagggtaaataatgcaaaccgttttagcgaaaatcgtcgcagacaaggcgatttgggtagaagcccgcaaacagcaacagccgctggccagttttcaaaatgagatccagccaagtacacgccatttttatgatgcgctccagggcgcgcgtaccgcctttattctggagtgtaagaaagcatcgccatcaaaaggcgtgattcgcgacgatttcgatccggcgcgtattgccagtatttatcaacattacgcctcggcgatctcggtgctcaccgacgaaaaatattttcaggggagcttcgattttctgccggtcgttagccaaagcgcgccgcagccgattctgtgtaaggattttattatcgatccctatcagatctaccttgcccgttactatcaggccgatgcctgtttactgatgctctcggttctggatgacgaacagtatcgccaactctccgccgtcgcgcacagtctgaaaatgggcgtgctcacggagatcagtaatgacgaagaacgggagcgcgcgatagcgttaggcgcaaaagtggtaggtatcaacaatcgcgatctgcgcgatctgtcgattgatttgaatcgcacccgccagctggcgccaaaactgggccacggcgtgactgtcatcagcgagtccgggattaacacctatggtcaggtacgcgaactgagccacttcgccaacggttttttaattggctccgcgttaatggcgcatgacgatcttaacgccgccgtccgtcgcgtgctgcttggcgaaaataaagtctgcggcctgacccgcgcccaggacgctaaagcggcctgtgacgctggcgcaatatatggcgggttgatttttgtgccctcatctccgcgcgcggttagcgttgagcaggcgcgagaagtgataagcggcgcgccattgcagtatgtcggcgttttcaagaacgctgatatcgccgatgtttgccagaaagccgccgtcctgtcgctttctgccgtacagctacatggcagcgaagaccaggcgtatgtcaacgcgctgcgcgaggcgttgccgcgcaatgtgcaaatctggaaggcgctgagcgttagcaatgcccttcccgcacgcgattatcaccatgtcgataaatacattttcgacaatgggcaaggcggcagcgggcagcgcttcgactggtcactgctacaggggcaaccgctggatgatgtgttactggcgggcgggctggcggccgataactgcgtccaggcggcgcaagtcggctgtgccggtctcgattttaattcaggtgtggagtcacagccgggcatcaaagatgctcgtcttctggcctcggtttttcagacactgcgcgcatattaaggaaaaaacatgacaacacttctcaacccctactttggtgaattcggcggcatgtatgtgccgcagatcctgatgcctgcgctgaaccagcttgaagaggccttcgtcagcgcgcaaaaagatcctgaatttcaggcgcaattcgccgatctgctaaaaaactacgcgggacgccccaccgcgctgacgaaatgccagaacattaccgccggtacgcgtaccacgttgtatttaaagcgcgaagatttactgcacggcggcgcacacaaaaccaatcaggtactgggtcaggcgctgctggccaaacggatgggtaaaagcgagattatcgctgaaaccggcgccggtcagcacggcgtcgcctctgcgctcgccagcgccctgctgggtctgaaatgccgtatctatatgggtgccaaagacgttgagcgccagtcgccgaacgtcttccgtatgcgtctgatgggcgctgaggtcatcccggttcatagcggctccgctacgctaaaagatgcctgtaacgaggcgctgcgcgactggtccggtagttacgaaaccgcgcactatatgctcggcacggcggcaggaccgcatccctatcctaccatcgttcgcgagttccaacgcatgattggcgaagagacgaaagcgcaaatcctcgacaaagagggccgtctgccagatgccgttatcgcttgcgtcggtggcggctcaaacgctatcgggatgtttgcggattttattaatgataccagcgtcgggctaataggcgttgaacctggcggtcacggtattgaaaccggcgagcatggtgcgccgcttaaacatggtcgcgttggcatctatttcgggatgaaagcgccgatgatgcaaacagcagacgggcaaattgaagagtcctattccatttccgccggactcgatttcccgtccgttgggccgcaacatgcgtacctgaacagcatcggacgcgcggattatgtctccattaccgatgatgaggcgctggaagccttcaaaacgttgtgccgccatgagggaattatcccggcgctggagtcctcccacgcgttggcgcacgctctgaaaatgatgcgcgagcagccggaaaaagagcaactgctggtggtcaatctctctggccgcggagataaagacatctttaccgtacacgatatcctgaaagcgcgaggggaaatctgatggaacgctacgaaaatttatttgcccaactcaacgatcgccgggaaggcgcttttgtccccttcgtgaccctgggcgaccctggcattgaacagtcactgaaaattattgacacactgattgacgctggcgccgacgctctggagctgggggttcccttctccgatcctctggccgatggccctaccatccagaatgcgaacttacgcgccttcgccgctggcgtcacgccagctcagtgttttgaaatgctggcgctgattcgtgaaaaacacccgaccattccgattggcctgctaatgtacgcgaatctggtgttcaataacggcatagatgcgttctatgcccgttgtgaacaggttggcgtagattccgtgctggtcgcagatgtcccggttgaagaatcggcccccttccgccaggcggcgttacggcataatatcgcgccgatcttcatctgcccgccaaatgcggatgacgatcttctgcgccaggtcgcatcttacggccgcggttatacctacctgctttcgcgttcgggcgtcaccggcgcggaaaaccgtggcgcattgccgttgcatcatctcattgagaagcttaaagagtaccacgccgcgcctgcgttacagggcttcggtatctcctcgccggaacaggtgtctgcggccgtgcgtgccggggcggctggcgctatctccggctcagccattgtcaagattatcgagaaaaacctcgcgtctcccgaacagatgttggcggagctcaggtcctttgtctcagcgatgaaagccgccagccgcgcataacgggttaagccgtcagcataacgctggcggcttaatgagaggttggcgccaaaccagaatcacgattcaggcgtacatcatcaatctttttggtgttattccccgtccagctttcaaaaagtctgaagtcaatttttgctaagaaaactcctaatcacgccgaaaaatttagcgttttcacgtcaatttcccccgcctttatgtaaagaaatgtcaacaaacaatgcattaacgtttccagggccgcagatagtgactcttgttattaataacaatgcaaagcattttctgttaaatcgcttattctaaaagaaaatatagaatatattatctctaaaccattttttgtgcattatttacgcggtaaatcacaactatttccgtcaatttgactaatcggtttaaccaactaattttaatagggtgtcgacacggttaaaaccgattttttcagcaagcaacgagacaggagaaataatatggccgaacatcgtggtggttcaggaaatttcgccgagaatcgtgaaaaagcatctgaagcgggccgcaaaggcggtcagcatagcggcgggaatttcaaaaacgatccgcaacgagcttctgaagccggtaaaaaaggtggtcagaatagtcacggcggacgtaaatccgataattcctgatttactgtaatgtaaatataacacatgcttttatcaagcaatctgcgagtcttctggctcgcagtattttgcccaggagaattagatttatgaatatcaaaaccgttgaagacctttttatccatctactttcagatacctatagtgcagaaaaacaattaaccaaggctcttcctaaacttgccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctacggcacgctagccaccctggccgagcagctcggctatagcaaagcattaaaactgctcaaagaaaccctcgacgaggaaaaacaaactgatttaaaacttaccgatttagcagtcagcaatgttaataaaagtgctgaacgcaaatcgaaataatatttttaattatcagcttgcatgattccgattttattatcggagcagattatcacgcattgaggaatgtaaaatgaattatactgaacattatcatgactggcttcgtgacgcccatgccatggaaaaacaggcagaatcgatgcttgaatctatggccagccgtattgaaaattatcctgatataaaagccagaattgaacaacatattagtgaaaccaaacatcaaattaccatgctcgaggaagtgttggaccgtaatggcatttcccgttcggtgttgaaagactccatgagtaaaatggcagcaatggggcaatctatcggtggcatgttcccttccgatgaaattgtcaaaggctcaattagcggttatgttttcgagcagttcgaaattgcttgttatacctccctgctggcggcggcaaaaaaagctggcgacactgcctcaattccaacgattgaagccattctgaaagaagaaatgcaaatggctgactggcttatcaaacatattccgcagacaacggaacaatttttactgcgatctgaagcagatggcgttgaagccaaaaaataaataataagcaggaggcaatatgtttcgacacgtaaaacaacttcaatatactgtgcgagtgagcgaacctaatcctggattagcgaacctgctgctggaacagtttggcggcccgcagggcgaactggcggccgcctgccgctacttcacgcaaggtttaagcgatgatgatgccggtcgtagagagatgttaatggacatcgccaccgaggagctgagtcatctggaaattatcggctcactggtaggaatgcttaataaaggcgctaaaggcgagctggcggaaggcaccgaaagcgaagcggaactttatcgctcgctgacgcagaatggtaatgacagccatatcacctctctgctgtatggcggcggccctgcgttgacaaactccggcggcgtaccgtggaccgcggcttatattgatactatcggcgaagtcacagccgatctacgctcaaacatcgcggcagaggcgcgagcgaagattatttatgaacgcctgattaacctgaccgacgatcctggcgtaaaagacacgctcagtttcttaatgacccgtgaagtcgcgcaccagctctcttttgaaaaggcgctgtattcgattcgtaacaacttcccgccgggtaaattaccgccggtagaacagtataccgacgtgtactacaacatatcgcaaggcgacgatccgcgaggtagctggaatagcgatgagaacttcaactatgtcgcagaaccgatgcctgctgttgatggcggcgatggcctggcgacagtgaaattgccgcgcgagcagatggcgctgctcaaagcgatggcagaaagaacgaaatcggaccccaccgttgatcctctcactggcgcagaactaggctgcggcgaaccgaaagaagacaagtgagttccgacaagtaaaatccgtgtgtcatgtccttttttgaccccgcctggcggggtcttttttcgtcacaacatcacgcgattagaaacgatagcctgccgagaacataaatacccatgggtccagacgcacgctgtcatgctgctgcacgccgcccattttataattggctgtagtatcaatatccatgtaccagacagaggcgccaattaaccagtcgcggttaatcaggtaatctaccccaacttgccctgccgcgccccaggaatccttaaagctcagatcggacagcccggtctttttaccattatcgttaaagtcgttatcgaagaaggtggtgtagttcacccccacgccgacataaggacgcactttgctgctggaatcgccgaagtaccactgcgccattaacgttggcggtaacaggtggaccgtggcgatatcacccgtcgcgcccgtacccaccttatggcggaacggcgtggccgccagcaattcaaccccgatattgtccgtcgccatgtaagtgaatgtcaggccgagttgcgtgttattactcacatcaaacccgtttaaatgccccagcgtaccacccgccccttctgtaggtctgacggttgccggacctgcacgcataaagaattctccggcttcgtgcgcgaacgcgctgcctgagagaagagttgttaacgccagtgccgccactgtaaattttttcatacccgctccatcgttatggttataaaagcgtgatgaatatacccacaatgaagtaataagtgatctaacacagatcacatttgttcttataatttaacatttattgatccagattaatttagaacttgtattgaaaatcctggttataggaattcagatcaattttgacatattcacgctatgcaaatatttgtctgctcctgttgccctggcgataaaggctggctaaggtaatcaatgtcccgcaatggcgcgtggcggtaagattcgcgaacactgcgggacagattaatttccgttgtaatctattgatacgtgagttttttgcaggtgaatcatgagcgttcttaacccatgcatgacatgcggtgcctgttgtgcctattttcgtgtctccttttattgggctgaaggcgacgatgccagcggacgcgttccggcgtcattaaccgagcctgttaccccttttttacgttgtatggccggtaccaaccaaaaacagccgcactgtaaagcgctaattggcacgccgggtgaaaacgtcagttgcgctatttatgaaaaccgcccttcaacctgtcgcgaattttcgatatcgggcgaaggaggcgaagtgaatgaggcgtgtaatcgcgcccgcgcgcgatacggattaccgccgctttacaaagatatgcttttccatacaactgctgatgctgccactgtagagttatccagggtacaattgcccgcaaattaacacctgcaaaactcaaggagagtgcatgtctatcacggcgaagtccgtttaccgtgacgccggaaattttttccgaaatcaatttattactatcttgctggtttcgttgctgtgcgcatttatcacggtggtcttaggtcatgccttttcacccagcgatgcgcaaatcgcgcaactcagtgaaggagaacatctggcaggcagcgctggcctgtttgagctggtacaaaatatgacgccggagcagcaacagatcctgttgcgcgcctctgccgcctcgacgttttccgggcttatcggcaacgctattctggccggcggtatcatcctgatgattcagttagtttcagcgggacatcgggttagcgcgctgcgcgctatcggcgccagcgcccctgcattgcctaaactgtttattcttatttttctgactaccctgttagtgcaaatcggtataatgctgattgtcgttccggggattattatggccattgtgctggcgcttgcgccagtgatgttggttgaagagaaaatgggcgtgtttgccgcaatgcgcagcagtatgcgtttagcctgggctaacatgaaactggtcgcgcctgcggtgataggctggttactggctaaaacattgctattgctgttcgcgcccagcttcgctgtactgaccccaaatgtaggcgctgtactggcgaatacgttgagcaatctgatttccgcagtattgcttatctacttattccgcctgtatatgttgattcgccaataatccgcaatgcgccgttacgcggcgcattcgacgctcgttgatgatggaatcgaagaatgaagcagtttctggattttttaccgctggttgtcttttttgcgttttataaactttatgacatctatgcggcgacctccgcactgattgtcgcaacggcaatcgtgctgatttatagctgggtgcgctatcggaaaatagagaagatggcgctgattacctttgttctggttgccgtcttcggcggtctgacgctcttcttccataacgatgaatttattaaatggaaggtgacggttatttatgcgctgttcgccggcgcgctgttaataagccagtgggtgatgaaaaaaccgttaatccaacgtatgttaggtaaagaactggcgttgccgcagcaggtctggtcaaagctgaacctggcgtgggcgctgttttttattgcgtgcggtctggctaacatttatatcgccttctggttgccgcaaaatatctgggttaactttaaggtcttcggactcacggcgctgacgctcatttttaccctgctgagcggcgtctatatctaccggcatctgccacaggaagataaatcataaccctcccgtgacttatcatcgccagactgcgaacgcctggcgatattttctccgcctttacgccctgcgctttcccgtcagtacctttattcccactattctccacacaatattcatagtagcatcgcggctgtaattttttctgatagtcggttttacaatgacaacaatggataatactcctcagggcgagctggttttacgtacattggccatgcctgccgataccaatgcgaacggcgatatttttggcggctggctgatgtcgcaaatggatattggcggcgcgatactggccaaagagatcgcgcacggtcgggttgtaaccgtacgcgtggaaggaatgacatttctgcgccccgtcgcggttggcgatgtcgtatgctgctacgcgcgctgcgttaaacgcggtacgacgtctattagcatcaatattgaagtctgggtgaaaaaagtcgcgtcagaaccgattggacagcgctacaaggccaccgaggcgctgtttatttatgttgccgtcgatccggacggtaaacctcgcccgctcccggttcagggttaagtatacccgcttacgccgccagcaggtgatggtatattcctactggcggcgccagagattactcaatctgcgccgcaccgttcagacggaagataatattgaccaccagcccggaacccggcttgcctgcttcatagcgccattttcgcatcgcattcttaacttcacgctcaaacatattggctggctgcgcggatagaatctgtacattttccactcgcccagcagcggtcacgtcaaacttcacctttacgcgaccttcaatacgtaacgcctgtgctcgcgccggatactgcggctggttacggctcagagctcgaggtccagtgggcacgctcaccgccggcttgctggtcgccgatgcggtgccgcttgttggccgcatcggggcgctattttcaaacggtgaggcaggacgcggtgcggctggtttgacttcgcgcttcggctgctcttcaacctttttcaccggttccggtttcggttttggcttgggttttggcttaggtttgggtttctcaatcaccacgggcgcttctttaggcggttcagggatcggctctggctccggttcgggttcaaccaccggctccggcggcggctgaaccgcctggggcggctccaggtcagcgggtgaaaccattgtcaccgtgataggctgcgctggcgcaggcaattcaataacctgatgtaccgaggtatagagcaaacctgccactacagcaccatgaatgcctacggaaaggagtgtcgaccagggaaagcgacgaggtaaatcaagggtcattgaagtcataatcgtttcagttgaaaaaccagagctgaattttaaatgcaaatagcaatcatattcaataaggcattgccgatagcggcatttaaaagatgatattgcacaaaaacaccacacaaaatgtgcatgtttaacaaagtcggtatctttacattgcagttaaatgccctttccaataacgtaatcagcaacttttaccgattaaggagctctacccgtgctgtatgttatttacgctcaggataatgccaactcgcttgaaaaacgcctctcggtacggcccgcgcatctggcgcgcctgcaacttctgcatgatgaagggcgattattaactgccgggccgatgcccgcagtggacagtaacgatcctggggtagccggatttaccgggtcaacggtgattgctgaatttgaatctttagaagcagcgcaatcctgggctgatgcggatccctacgtcgcagcgggcgtctatgcgcaggtttcggtcaaaccgtataagaagatcttttgaaaaggatggcctgttgggcaccgcatacggtgccctttctggctcacacaccgtgaatcgcaaagagtaatgaattacgctgacgattaaagatgcatttcctgatagtatggatacgcatattacggcgtgattgcccttcaagccaacgcgctttacggcggctcgcctgacgtagcattcgccagcgccccacttccgttctactacgcttcatgtttacgactctcactgtaacagaagcgccattataccccctcgccggatgcagaccagcgcttttcccgtgtttttatttgccatgtgaatcctgacgcgtaaactcttaacaacacgctttctaaaggatttttaaagttatgacaaccttctacaccgtggtgagttggctggtcattttgggatactgggttctcattgccggcgtcacattacgtattctaatgaaacggcgcgcagttccctccgcaatggcctggttgttaatcatctatatccttccgctggtcgggatcatcgcctatttgtccgtgggcgaattgcatttaggcaaacgtcgcgccgagcgtgcccgcgccatgtggccgtctaccgccaaatggttgaatgacctcaaagcctgcaaacacattttcgcgcaagaaaacagtagcgtcgcatcgtccttgtttaagctgtgcgaacgacgtcaggggattgcgggcgtcaaaggcaaccagttgcaattacttaccgactccgatgatgtcatgcaggcgcttattcgcgatatccaactggcgcggcataatatcgaaatggtgttttacatctggcagccaggcggcatggcggatcaggtcgctgaatcgctaatggccgccgcccgccgcggcatccattgccggcttatgctggattccgcgggtagcgtcgctttcttccgcagcccctgggcggccatgatgcgtaacgctggcattgaagtcgtagaggcgctgaaggtgaatctgatgcgcgtctttttacgccgtatggatcttcgccagcaccgtaaaatggtgatgattgacaattacatcgcctataccggcagtatgaatatggtggacccgcgttttttcaaacaggatgccggcgttggacaatgggtcgatttgatggcgcggatggagggtcccgtggcgacagcaatggggattgtttactcctgcgattgggaaatcgagacgggtaaacgcattctgcctcccccgccggacgtgaatattatgccgtttgagcaggccagcgggcataccattcataccattgcttccggtcctggttttccggaagatctcattcaccaggcactattaaccgccacctatgctgcgcgcgaatatttaattatgaccacgccatatttcgtccccagcgacgatctgctgcacgccatttgtaccgctgcgcagcgcggcgtggatgtcagtattatcctgccccgtaaaaatgattcactgctcgtcggctgggccagtcgcgcctttttcagcgagttactggcggcgggcgtgaaaatctatcagttcgaaggcgggctgttgcataccaaaagcgtgctggtcgatggcgaactgagcctggtcggtaccgtgaatctcgacatgcgtagcctgtggcttaatttcgagattacgctggtcattgatgatacgggtttcggcgccgatctggctgcggtacaggacgattatatttcgcgctcccgcctgttagatgcgcgtttgtgggtaaaacgtccgttatggcagcgtattaccgagcgattgttttacttctttagtccattgctgtaaaacgtgaccaacatgagtaaacaggtagtcactatggaaatggatctgaacaatcgcctgactgaagacgaaacgcttgagcaggcttacgatatttttcttgagctggcggcggataatcttgatccggctgatatcattctgttcaatttgcaattcgaggagcgcggcggcgcggagttgtttgatcccgctgaagactggcaagagcacgtcgattttgacctgaatccagacttttttgccgaggtggtgattggcctggcggataccgaagacggcgaaattaacgacatttttgcccgcgttctgctgtgccgggaaaaggaccacaagctgtgccatattctctggcgcgaataagcggttcaggccggatggcgtctgatagcgccctccggcaagcctgtttaatccggtagcttactgccgcatcggttacaatattgcgcgctatgttcatgctggctttgctggcactgcggacattttcgctgccagtgacgtttttgaaacgcgctgctcatgtgcgtggtaatcagtcctgtaggaatcgcaatcaccgaataaccaatcaaaataagcaccgacgcgacaatacgtcccagcggcgtatgcggcgtaatatcaccgtaccccacggttgtgactgtcactatcgcccaatacaccgaggcattaagcgtcgtgaagccatatttcggtccttcaataagatacatcagggcaccgaaaataatcatcacgatcgcaataaatgaatagaacagaataagctgatgacgcgcgctaataatggcgctccagaatacgcgcagggatggcataaaacgtagcagtttaagaatacgcagcacgcgaatcgctcgcatagcgcgccaggcaaacatatagttcaggctaatttccggccatagccacatgacgtacagcggcaaaatcgtcaccagatcaataaatccccagaaactaaaaacgtattttgccggttcgggccaactaaacagtctgagcaagtattcaccggtaaatatcagggtaacgcacagctccagccagacaaaaatatgccattcatcaaatgtcaggtgatattccgttcctacgcctgattcaacaaaaatgaccagtacgctaagcagcgcaaacagcgcgcataacccttcaaaacggcgacttgagcgcgtagtcaaatcgaacagattatgataaagacgacggcgaaccgacgacaaagaaagtgacacggtaacctcacctaaaagaagggctgacgaattgtcagcccttgcgattataacgggtctactttaaggcaggaaacggcatggcgaaaactcccttccaacaccggtcgcgtttgcgcgcattctggcccggctagcggacagcgtgtacggaacacgcagccggaaggcgggttaatgggcgaaggtaattcgccctccagcaattgtatcttcttatttcgctccagatcgggatcgggaatcggtaccgccgacatcagcgctttggtataaggatgcagtggattatggtacacctcatcataggtgcccaattctaccgcatgaccgagatacatcaccaggacacgatcggatatgtgctttacgaccgccagatcgtgcgcaataaaaatcaacgacagccccatctctcgctgtaactgctggagcaaattcaccacctgcgcctgaatagaaacgtccagcgccgacaccggctcattgcaaataatgagcttaggctccaggatcaacgcccgggcgataccgatgcgctggcactgccccccggaaaactcatggggataacggttgatgagattcggcagcagccccactttcagcatcatggctttcacgcggtcacgcacgtcctggcgcgaaagcttaggatgataagtgcgcagcggttcagcgataatttcgccaatcgtcattcgcgggttgagtgacgccagcgggtcctggaaaatcatctggatgtcgctgcgcacctcgcgccactcatccgctttcatgcccaacagatcttttcccagccaggcgactttaccgtctgtcgccttcaccagaccaataatggcgcgcgcaaacgtcgacttgccgcagccggattcccccaccacgccaagcgtttcgccttcatacaggcgtagcgtaacgccgtccaccgctttcagggttttcggcggttgccagaaccactgcttcccttctttgatatcaaaatgtacttttagatcggcgatttcgaggagaactttacgttgttcaatcacagcattcatagcagttcctccaccggtttaaaacaggcgcgcaagcgaccaggactgaacgcttcaagtggcggcgcattattgcagatctccatcgcatgaggacaacgcggctggaacggacaacctttaggcaaacgcaataaattgggaggattgcccggaatcgtcagcatttccgccccctcgctatccagacgcggcaccgcattaagcaagcctatcgaatacggatgaacgggctgataaaagacatcgcgcgccttaccgtattccatggtacgcccggcatacattaccaggaccttatcgcaaatacccgcgaccacgcccagatcgtgggtaatcatgataatggcggtattaaattcgcgctttagctcattaagcaaggtcataatctgcgcctgcacggtaacatcaagcgcggtggtaggctcatcggcaataagcagtttcggcctgcacaacagcgccatcgcaatcatcacacgttgacgcattccgccggaaaattcgtgcgggtacattttcatccgtttgcgcgcttccggtatttttacggcatccagcattctgacggactcttcaaaagcttccgctttgctcattcctttatgcagcatcaggacttccattaactgctccccaacgcgcatataaggatttagcgaggtcatcgggtcctgaaaaatcatcgaaatctgttctgcgcgcagcgtattcagttcgcgctcaggtagattaagaatttcacgtccgttaaaggtcgcggaaccgccgattcgaccattcgtcgccagcagtcccattaatgcgaacgccgtttgcgatttccccgatccagactcgccaacaatacctaacgtttctccagcgcgaagcgtaaagttcagatcgttgaccgccgtcacatcgccatcaggcgtagcgaacgtaacacgaagatcgtttacctccagcagtacattcgccggttgcggcgcctgagttgcggtttctgataagctcatggctgtactccttaacgatcttttgggtcgagggcatcacgcaggccatcgccaataaagttaaaacagaataacgtcaccacgagaaagccagccggaaacagcagcagccacggtaagacttccattgaatttgcgccatcgctcaacaacgctccccaactgcttaacggttcctgcgtcccaagccccaggaaactgaggaaagactcaaacagaatcatgctgggcaccagcaacgatgcatacactaccactacgcccaggacgttaggcacaatatggcggatcacaatgctggcggtcgacacaccacccacctgcgcggcttcgatgaactctttacgtttaagacttagggtttggccacgcacgatacgcgccatatcaagccaggagaccatgccgatggcgacgaaaatcaacagaatgttctgccaaaaaacgtcaccagcaaaatcacaaagaacataaacgggaacgagttgaggatctccaacaaacgcatcatcacagaatcaattttgccgcccagatacccggacagcgagccatacagcgttccgacaatgaccgccaccagcgcggcggcaatcccgaccatcaatgagatacgcccgccgatggcaacgcgcaccaacagatcgcgcccggaagagtcagtgccgaaatagtggccggacgccatatccggcgcgctggacatcatgccccagtcggtatcgaaataggtaaattgcgacagcataggcgctactgtcacgaatagggctatcagaaacaggacaataagactggccaccgccgcacggttatgcataaagcgccgacgggcatcttgccaaaggctgcgaccttccacctccagcttttcactgaaattttccagcgtctcgctgtttttcttacttaacatcatcgcgagctccagtatcaatagcgaattttcgggtcgataacggcatagagcacatcgacaatggcgttaaacaatatggtcagcgccccgactaaaatggtcaaacttaacaccagcgagtaatcgcggttgagcgcgccattaacgaaaagctgcccaatgcccggtaagccataaatcgtttcaatcaccattgagccggtaataatgccgacaaaggctggccccatataggataaaaccggcagcagcgcaggttttaacgcatggcggaagatgattctgcgcatcggtaatccttttgcccgcgcggtacgaataaagttcgaatgcagaacttcaatcattgagccgcgcgtaatacgagcgatgctggcaatataggccagtgaaagcgcgaccatcggcaggatcataaattttaacgccccgccgttccagccgccgccaagcagccattgcaaggttattgcaaagaccatcaccagtagcggcgctaccacaaaactggggataacgacgccggtcatggcaaatcccatcaccgtataatcccatcgcgtattttgctttagcgcggcaatcacgccagcgctgacaccaataatgaccgccagcaaaaaagcggcggcgccaagtttcgccgaaacggggaagctggcggcaaccagatcgttgaccgtgtaatctttatatttaaacgatggtccaaaatcgccatgcgccagctgcttcaggtagctgaagtactgcgtcatgatgggatcgttcagatgatattttgcttcaatattggccagcacttccggcggcaatgcgcgctcgccggtaaaaggactccccggcgcgaggcgcatcataaagaaagagatggtaataagaataaacagcgtcggaatcgcttccagacagcggcgtaaaataaatttcaacattgcccgtaccttctggcctgtgcctttacttcccggacgtgacaaaagatccgccagggaaagttatagtgcgatgaaaaaagacaccatgggacaaccgcagttgtcccatgtcttgccattaatgtttgataatatataagtttttcacataaatattatccagcgggtctttaccggtatacccgcccacccagggtttcaccaggcgcgcgttaacgtagtaatacaccggcacaatagccgagtctttatctaactgctgctccgctttagcgtagagttcgctgcgctgcgtatcgtccgccactttcagcgtgtcggcaatcagcttatcaaacgccgggctcttataatgcgcggtgttatttgaactgtcggacaacatggtattcaggaacgaggtcggttcattataatctgcgcaccacccggctctggcgacatcaaaggtgccctgatgacgggtatccaggaaggttttccattcctgattctccagattcacattgacgcccagatttttcttccagatagacgccacggcaatagccagttttttatgcagatcggaggtgttatacagcaggtcgaatgttaagggcttatccgccgtaaagccggcttcagccaacaatttcttcgcttcttcattacgcttttgctgggaccatttgaaccactcaggctctaccagttttgcgccatcggtatacggcggcgtgtagctataagcgggtaaatcgccctgatttttaaccttattaacaataatgtcgcgatctaacgccagtttcagcgcggtacgcacgcggacatcgttaaacggcgctttttgattattaatttcgtaataataggtacacaaataagggtctacgcggacttcattcgggatctctttcttcagtttctggaataattcgatcggcatattgttataagtcatatcgatctcgccgctgcggtagcggttaacatccgtcacctccgaagagataggcaaataagttacctgattgatgacggttttgtcgttatcccagtattgcgggttacgctccagcacgatacgttcgttcaccacccaattttttaacttataagcgccgttagtgacaatattggctggttgcgtccatttatcgccaaatttttcgaccgctgatttcggtacaggagacactgaagggtggaccaacaatttgtagaaataaggcaccggctcacttaaggtcactttaaaggtgtgatcatcaagcgcttttacccccagatcggtggcgggttttttaccggcgataatgtcatcgatattaacgatatgaccgtattgcagatagctggcgtacggcgatgccgtattaggatcggccaggcgttgccagctataaacgaaatcatgggcggtgacgggcgtaccatctgaccatttcgcattttcacgtagatggaatgtccagactttaaaatctttattttcccatttttccgcgacgcccggtgaaggatgcccctcgacatcactaattaataagccttcaaagagatcacggctgacgttcgattccggcacgccttcaattttatgcgggtcgagagactgcacttctgatccattattacgtaccaacgtttgcttgtcggctaactgaacaccggcgggcacgtctgccgcagtcgcggcgctggcggcgatgaacgcagtgagtattcccactgcaattaaactttttttcgtgatgttagacattgtgtttgtactccactcattataattactggtttttaccagcctgtttaatcccgtcagggctcctgtacagcactggtggtgtactgccaggtctgtcactgcttttgctatcaccgactttatttattctgacgattcgttcgatcgctttcgtcgattcggtatacgacgtacctgcccacgtcgcacgttatttctgacaaccatgtaaatgaaaatagttatcaacaatgtgaaatcttctgcaaaatgtttggccgaaaagtatcaaatgcgtttctgaaccgccaattcattttacaattttgttaaccaattctcttttatggaaaattgcctgcccagaaaaacggttaaagaatgttaaaaatctttgatttattctttataatcaataagttgaaagaaaaatatctctctgtcgcatcgtaggttatgcctgcgccagaaaacacacacaaatttaacaaatgctcattatttagcacattcatctacgatggagctgaaacaactaataacatttcaataatccttcatcaagccccagagtatggtgtgaataaaataacagacctaccgcttctcacggtctcagtaatgttcataatagattgattaataaaaataaatagcgttagattatattagtattttttatcatttaaacgctgaatgcttatcaaagtaagaagtgttacgtgggaatgtcactgggaatgtcacaaggcggcccccttagggcgccgcctgtaaatcaacaggtgggagtttagttgagcaagccggggaaaatgccttttattcctgtgacaataaattcgatgccgagcgccattaacaacaaccccatgattcgggtaataacgttgataccggtttgccccagcaaacgaaccagccacggcgccatacggaacacgccccagcagcaaagcgcaaaaagcgcaatggcaactgaaaaaccaagcaaatgcgcgatgctgtgataacgcgtcccccagacgatagtggagctaatcgcccctggccccgccattaacggtagcgctaacggcacaacgccaatgctctcgcgtatggccgtctctgacttttcttgcttgttttgtttatcttcccccagcttcccgctgatcatcgacattgcaatggtgacaaccaggataccgcccgcaattctgaacgaatcaatagaaataccaaacagctgcaggatgccatcgccgaggaataaggaactccacaagataatcgcgaccgacagattcgcggtgaggttagttttattacgcgccgtggccgtctggtagctggtcatgctgatgaaaacgggaataatccccaccgggttaaccagcgcaaagagcccgataaagaacttaaagtaaacaggaaaatcaaaaagcggttgaatcacggttagctccgaagcgttagccggatgaagtcaatgttcgttaatgatcaaaacgcgcagaagatacgccttttattcgcatagttcacctcttatctacacctaatttcatccattcatcgctgttatttatatgtactcgttatgctaatccacttactcttcatgacaacgatttcttaacaatttacataaaaggctaaaatggcctgctgaaaggtgtcagctttgcgtaatcttgatttagatcacacaatcgctactcagaagtgagtaatcttgcttacgccacctggacgtaacgcgttagagttaaatgatactaacgcagaagctcttttagtaaatcagagcgaaacggacgttaagtaaccacctgaatttcaggtatttatacaaagtatcgtcgatctgtctatactcacgtatcgcgcagatgatttactaaaaaagtttaacattatcaggagagcattatggctgttactaatgtcgctgaacttaacgcactcgtagagcgtgtaaaaaaagcccagcgtgaatatgccagtttcactcaagaacaggtcgacaaaatcttccgcgccgccgctctggcagccgctgatgcccgcattccgctggccaaaatggccgtcgccgaatcaggtatgggtatcgtggaagacaaagtgattaaaaaccacttcgcttctgaatatatttacaatgcctataaagatgaaaaaacctgcggcgtgctgtcagaagacgacaccttcgggaccatcaccattgctgaacctatcggcattatttgcggtatcgttccaaccactaacccgacctctactgcgatcttcaaatcgctgattagcctgaagacccgtaacgccatcatcttttctccgcatccgcgcgctaaagaagcaactaacaaagcggcagacatcgttctgcaagcggctatcgctgccggcgcaccgaaagatctgattggctggatcgatcaaccttccgtagaactgtctaatgcgctgatgcaccacccggatattaacctgatcctcgccactggcggtccaggcatggttaaagctgcatacagctccggtaaaccggcaatcggcgtaggcgcaggtaacaccccggttgtcattgatgaaaccgctgatatcaaacgcgctgtggcgtctgttctgatgtctaaaaccttcgataacggcgtaatctgtgcttctgaacagtctgttgtcgttgttgattccgtctatgatgccgttcgcgaacgtttcgccagccacggcggctacatgctgcagggccaggagctgaaagcggttcaaaacgttattctgaaaaatggcgctctgaacgccgctatcgtcggtcagccagcctacaaaatcgctgaactggcaggcttctccgtaccagaaaccaccaagattctgatcggtgaagttacggtcgttgacgaaagcgaaccgttcgcacacgaaaaactgtctccgactctagcgatgtaccgtgcgaaagatttcgaagaagcggtagaaaaagcagaaaaactggtcgctatgggcggtatcggtcacacctcctgcctgtacactgaccaggataaccagccagaacgcgttgcttacttcggtcagatgatgaaaaccgcgcgtatcctgatcaacaccccggcctctcagggtggtatcggtgacctgtacaacttcaaactcgcaccttccctgacgttgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctctctgcccatcgcgctggatgaagtgattactgatggccacaaacgtgcgctcatcgtgactgaccgcttcctgttcaacaacggctatgcagaccagatcacctctgtgctgaaagcggctggcgttgaaaccgaagtcttcttcgaagttgaagcagacccgacgctttccgttgttcgcaaaggcgctgagctggctaactccttcaaaccggacgtgatcatcgcgctgggcggcggttccccgatggacgccgcgaaaatcatgtgggtcatgtacgaacatccggaaactcacttcgaagaactggcgctgcgctttatggacatccgtaaacgtatctacaagttcccgaaaatgggcgtgaaagcgaaaatgatcgccgtcaccaccacttccggtaccggttctgaagtcacaccgtttgcggttgtgaccgacaatgcaaccggtcagaaatatccgctggctgactatgccctgaccccggatatggcgattgtcgatgccaacctggtgatggatatgccgaagtccctgtgtgcgttcggtggtctggatgcggtaactcacgccctggaagcttacgtttccgtactggcttctgagttctctgacggtcaggctctgcaggctctgaaactgctgaaagaaaacctgccggcgtcttaccacgaagggtctaaaaacccggttgcgcgtgaacgtgttcacagtgcagcgactatcgccggtatcgcgtttgccaacgccttcctcggtgtatgtcactccatggcgcacaaactgggctctcagttccacattccgcacggtctggcgaacgccctgctgatttgtaacgttatccgctacaacgcgaatgacaacccgaccaagcagaccgctttcagccagtacgatcgtccgcaggcacgccgtcgttacgctgaaattgctgaccacctgggcctgagcgcgccgggcgaccgtaccgccgctaagattgaaaaactgctggcatggctggaaagcattaaagctgagctgggcattcctaagtctatacgtgaagcaggcgtgcaggaagctgacttcctggcacacgttgacaaactgtctgaagatgccttcgatgaccagtgcaccggcgctaacccgcgttatccgctgatctccgaactgaaacagattctgctggatacctactacggtcgtgatttcaccgaaggtgaagttgcagcgaagaaagacgtcgttgccgcaccgaaagcagagaaaaaagcgaaaaaatccgcttaattcgttatctgttttagcatgacaataacggcctcaattgaggccgtttttttgttttacctgtttatctgatgcctgaaggcgctatgcttaccatctggcctacgcgctcacggcacgcccttcgtcaggaggcctgaataatgacctccaaagcgctacagggcgttttataagccgatctttacctcaggtatcatatgtgccgatggcgctcctgaatcgccgtcagtgagccctcctccagcgcgtccttataatgcttacggcaaactgaaacgtagcgttcattcccgccaataaccacctgttcgccttcgttataaggcctgccgtcctgatcaaggcgcaaaaccatactggctttacgaccgcagaaacagatagtttttaattccaccagcttatctgaccatgccagcaagtattggctgccgacaaagagctccccacgaaagtctgttcgtagcccatagcagagtactggaatatctaatttgtcgacaacctcggataattgataaacctgctggcgagtcaaaaactggctttcgtcgactaacacgcaatgtattgtctgccgcgcgctctcggcacgaatctcttcaaacaaggatgtattttggttaaacaattttgccggcgacgacaaaccgatacgagagctgactttgcctgcgccgaaacgatcgtcgatttccgccgtatatacgacggtacgcatcccgcgttcctgataattgtatgaagattgcagcagtgcagtcgacttacccgcattcattgccgaatagtagaaatatagctgtgccattggtcgcaggacctcacctgagtgaaataaagattggcgggattgtaccataatttaccgatgcgacggcgcggctcgcgctccggtgagtattaagaattgtacaaacatcgctcactatacccaaaataattcgagttgcttaaaggcggcaagggagtgagtccccaggagcatagataactatgtggctggggtgcgcgagcgtagccaacacataagcaacttgaagtatgaagggtatatacacattccttcacaaattatgccgttaaaattcatcaacaatgcttatcatcacccgccaatatgaaaaccttgtacttattgttaccgttactcatacccaatgcaaagtaatagggttttcttgtaaggaaagctaatacaagagattgatatctctgcaatgagatcgtatttcatcatgataaaatgtgacctgaatcctaaatttttagtgacagacggtgagtatcccccctggcaataagctcttttttgtgcggcgcctcaaggaaaatttaagttgagataattaaaacgtgtgcttaataaagcgtaattttgaattccttacattcctggctattgcacaactgaatttatcgctctattattagctcaacaaaccaccccaatataagtttgagattactacaatgagcgaagcacttaaaattctgaacaacatccgtactcttcgtgcgcaggcaagagaatgtactctggaaacgcttgaagaaatgctggaaaaattagaagttgtcgttaatgagcgtcgtgaagaagaaagcgctgctgctgctgaagtggaagaacgcactcgtaaactgcaacagtatcgtgaaatgttaattgccgacggcattgacccgaatgaactgctgaatagcatggctgccgctaaatccggtaccaaagctaaacgcgcagctcgtccggctaaatatagctatgttgacgaaaacggtgaaactaaaacctggactggccagggtcgtacaccggctgtaatcaaaaaagcaatggaagaacaaggtaagcaactggaagatttcctgatcaaggaataatttacttcctggatgcttaaaatcccgccgctggcgggattttttttgcctgagttctccgctgacgaccccaggcataaaaaaagcgccggatttaccagcgcttctgttaaaaaatttataacgtatcgttacttcttaatacccatttcttcttcaagccaggctttaaattcagcacccagcgaattatgacggatgccatattcaacgaatgcctgcatatatcctaacttattaccacagtcatggcttttacccttcatgtggtaggcttcaaccgtttctttttcgatcagcatatcgatagcatcggtcaactgaatttcatccccggcgcccggaggggttttcgccagcaacgcccagatatccgcgctcaacacataacgcccgacaatcgcaaggttagacggcgcgacatccgcttttggtttttcaaccacgccaaccatcggcacactttcgcccggcgccagctcaacgcctttgcaatcgaccacgccgtatgcagtcacatcttctactggctcaaccataatctggctattgccggtttcgtcgaaacggcggatcatttcagccaggttatcctgagacaggtcggactcatattcgtcaagaataacgtctggcagaataacagcgacaggttcgtttccgacaacgggatgcgcgcacaatacggcatggcccaggccttttgccagcccttgacgtacctgcataatagtgacatgcggagggcaaatagactgaacctcctccagaagctgacgcttaacgcgtttttccagcatcgcttccagctcaaaactggtatcaaagtggttttcaatagagtttttagacgagtgcgtaacaagcacgatttcagtaatgccagcagcgatacattcgttcacgacgtactgaattaatggcttatcaaccagcggcagcatctctttcgggatagctttggtcgctggcagcatcctggttcccaatcccgcgaccgggataacggcttttttgactttcgaattaagggcagccatttaaaattctcctggactgttcatgtattgaacgtgttcattaatctgtatcgtgttccagtatatcagtaccagaacaagcctcaggtccaaaaaggacttatattggtataattaagacaaatacttataaatctgccgcagatagtaacactcgtcgggaaaggccggtaaagcaatttccgctcactcttccgtttggtcattccgcagacaacatcaatcgcagacgccctcctgcgccccatatttgacactgccacgagtcgcaacgctggcttaattggttaaggtaggcgttacccaatgttcctagcggcacgccgctgctaatttgaacctgatgagcgcccgtatttaaggtggcgttcaatccggcggagacgagaatcaaatttttgagctcactgtgatagtagccgacaaatagcgggaattgcccaggtaaattggcttgtctgagcagatgatttacctgttttaatagcgcgcctaactccggtaaacggtgcttttgttggccgagctgatcctgcaataagccgttaaatagcgcccgcagcaacaatgcggctaacacgccgttatcgcccgcccgggtgacatccaggcaataaaatgccagttcgttatcagatagcggcgcaatatccagcaccagtccaggctgatcggcggagacgagctgccggtaattaatgcggcaatgagaaatcacctgctgtaccgggggctgcaattcctgcaacaattgcgctgcggcggtcggattactcaccattgcatcccagtcacgaaacaggcgttcttcttcttcaacccgcgagttaaacatattagggtataagcaagcgaatacggtttcccgcaagcggttgagatcttttaccggcttcagcaagacatcttcaaccccaaggcgtaacgctttggcgatatccgccatattttctgttgcggaaataaccagaataggcgtctggtctccgcgattacgtaagttttctaccagtttgagaccgttcattctcggcatagcgatatcacatatcatgagatcaggggtaaaacgccccattaactccagggcatccaccccgtcgcctgccaatgccgttgtcgctcccaaagaggaaaaccacgaatccagaagcgagcgaaatacaggctcgtcttcaacaataagaatctgttttccgaccaatggctgcgtcatgttctctcccctgactggctttaatcaatagtggcatggtattgccgcttgcgcctgtcagaatttgcttaagtgatcgtaaaaggtacattaaacgtcggtacgcaccaagggtataagttcgtccatctttttctctacggctaactgacccgccgcaatagcggcatgggcgcgatgaaaatccagcgtagagatttgcggacagaatggttgaatgagaatatcaggcggatcgccagccatacggttacgtttaagacgattttccaacacctggatggaggttgtcatgatttccattgccccagacgaactcacgccacggcgtgaagtcaggctactgaaacgttcttttaaacgcttatgccagggcagcgcatcatcgctctcttcattgatattcccgacatttacagagagcaaatcttgctgcatgaggtgggcatcatgttgcaggtctaccgcaataacgatatcagcccccagcgccctggttaacgaaacaggtaccggattaacgactgcgccatctaccagccagtaaccgttatgttcaaccggagacatcagccctggcatactgcacgacgcgcgtacggcaaggtgtagatcgccttcagtaaaccatagctctcgtcccgtgctaagattcgtcgcgaccgcgccaaaacgtcttgaacagtggtcaaaatccgtgacgggcataatatcccgatagtgattaaatacgcgtttgccgcgaagcaaccctcctctgccccaggatacatccatcaggcgtaaaacatcccagtagcggaatgaacatacccactgttcaagcgccgataatttattacaggcatacgcggcgccgaccagtgaacctattgagcatcctgcaacgatatcaatatcaatgcctgtttgcttgagggctttgatgaccccaatatgagaccatcctctcgctgcgccagatcccagcgccagccctattttcatttttctcatcgtacttaacgacttcccctggcttcaagacgtagcaacatcgccactgctcagttaacataatgccaccctggcgttcaacgccgttttatattcagggagattattgtgtctcagccttgtccctgtggtagcgctgacgagtatagcctatgttgtggtcgtattgtgtccggagaacgagtagcacccgatccgtcacatctcatgcgctctcgttactgcgcttttgtgatgaaagacgcagattacttaattaagagctggcatccaacttgcaatgcggccgcgtttcgtgatgatatcatcgccggatttgccaataccaggtggctcggcctgactatttttgaacatacctagtcagaagcagaaaatacagggtatgttagttttatcgcgcgtttttccgaacaagggaaaaacggggcgattatcgaacgttctcgttttatcaaagaaaacggtcagtggtattatattgacggtacccgcccgcagttgggtcgaaatgatccctgcccgtgcggttcaggcaaaaaatttaaaaagtgctgcggccagtgacgcctgacagtattgatacagcaaacactctcaacaggatttttccggcaatgcaatcactacaacgtaaagttctgcgtactatttgtcccgatcaaaaaggccttatcgcgcggattaccaacatttgctataagcacgagcttaatattgtgcaaaacaatgaatttgtggaccatcgcaccggacgcttttttatgcggaccgagctggaaggcatcttcaatgattccactcttctggccgatctggacagcgccttaccggaaggctctgttcgtgaactcaatcccgccggacgccgtcgggtagtgattctggttaccaaagaggcgcattgtctgggcgacctgctgatgaaagccaactatggcgggctggatgttgaaatcgccgcggtcattggcaaccatgaaacgttacgctcgctggttgaacgttttgagatccctttcgaactggtcagccatgagggattaacgcgtgaagagcatgacacgaagatggcggacgccattgatacccatcaaccggactatgtagtgctggccaagtatatgcgtgttttgacgccaggttttgtggcgcgcttcccgaacaaaattatcaatatccaccactcattcctgccggcgtttatcggcgcgcgtccttatcatcaggcctatgagcgcggcgtgaaaatcatcggcgctaccgcgcactatgtgaatgataatctagatgaaggcccaatcattatgcaggacgtgattcacgtcgatcacacctacaccgcagaagatatgatgcgtgccgggcgcgacgttgagaaaaacgtattaagccgcgcgctgtatcaggttctggcgcagcgggtctttgtttacggcaatcggacgattattctttaatcgtcagtaatatgaattgattagctttaatccgttacggatgaaaagtacgcaaacagttcatttcaggcaaaggaatgctttacagcgacgtgtcatttgatatgatgcgccccgcttcccgaaaggaagcgggccagtattaagcattaccccgtggtggggttcccgagcgatcataagggagctgactgcaaatctgccgtcatcgacttcaaggttcgactcgagcaatagtgagagaacgttgccgcaggcaacggcccgaagggtgaggagctttagctccgaataatccttcccgctatagaatgcaagcagcataatgaatttatcccgtggtggggttcccgagcggccaaagggagcagactgtaaatctgccgtcatcgacttcgaaggttcgattcgagcgcagcgagaaagcgttgccgtaggcaacgacccgaagggcgaagcgcgcagcgctgagtcatccttcccccaccaccatcatgatcttcagaaagcatctaaccttcattcgacatcggtttgtcataattctacccatgtggggaaggatgagaagcttcgactaaggttcgattcgagcgaaagcgagagaacgttgccgcaggcaacgacccgaagggcgaaacgcgcagcgctgagtcatccttcccccaccaccattacttcataaggcaccaatttcaaatcaatcagcactgccccgtatccttaccccacaggcagacttcacaccatggcgccatagcttattggctatcttatcaatacttcttcctggcaatctttttcgcctcctttgactggttgatttttcgcctgatgagatcaaaggcggcatatgtctcgctaagttgatctggggtaagcgttcccttgagtcggtttctttcggcaatgagcgctgaacaatcatccttagatttttccgtatatatacttgccatgtaataccaaatataggcctgcttattatctttaggcaccccctggcgcccatgagcataaatttccccaagcgctaattgtgccggagtaaacccctgctctgccgctttaaggtaccacttcagcgcattccggctattttcaggcacgcctcttcccatgctatatgctacgccaagctgatattgcgctttcgcaaaatcctgttttgctgcttttcgataccatgcgatagcctgtctgtcgctttgcgcgacgccgcgaccaaaagcagacatgatgcccagatgcgtttgcgcagcaggcagtccctggcgtgcggctttgcgataccacgccagcgcctgttggtagtcctgagaaacggcctcgccctgcataaacatcacgccgatcgcatcctgcgcctcggccaatccctgcgctgcggctctgcgataccactccagcgccagattgtgatctttcaataagtgataaccgttgtaataccatacgccaaaattgaactgtacctttgccatcacgcgttgcgctgtttttcgataccacgtctgagagtgaacctggtcagcgggatgcgctttatcatagagcgcattcagcggaatgtggcctggcgtatagctgcctggtataccttcattaagccagtaaactgcctgacgataatcctgaggcacgccttcaccataaaaataggcaacaccgagataaagttgcgcggggtagtacatattttccgccgctttacgcatcaagatcgccgtttgctgataatcctgaggaacgccctgaccgtgggcgtacattactccaagcttaaattgtgctgacgaagctgaaccctggccgcggacaacgcccgcatcattggttggagaggcggcttttcgataccactccagcgctagctgggtattttggggaaacccatcgccatacatataggcgtcaccgaggatttcttgcgtactactatcccctagttctgccgccttgcgataccactccagcgctttttgccgactaagtggaaaattttcaccatagttgtaatgatagccaaggatgaaataggaaaaatcagaaccttgtttacccgctttctccagccattttatggctagtttataatcaggcttaacgtatcgcccctccgcataccagcttccaagcgagaactgcgcgccttcatctccttgttccgctttttgctctaattcctgaacgtactggcattcttctgagtcggggggatagcgctcctcgcagacagcagcgtgagccatttttgaaataaatatatttaatattattattttgaaaattgatgaaaaacgcatacaactatccttattgtcgtttatggcgtgattatatgctgcatcatcctttttctgcttacaaaaaactcgcacagatgctgaataaacccagaaacaaagagtccggattcagatgccagacatggcagacccgctgtaaacgaaacaaggcggcggtcgataaggcatttatgctgcactccggcaaacagccataaaaaaactccgccgaagcggagtttagggcatcgagagaaaatcagtgacgcgcacgtacaatctggtatttgcgggtcaggtactcgaccggcacgctccagatatgcaccaggcgcgagaatgggaataacaggaacagcgtcatccccagtaccaggtgcatacggaagataaaggctacaccgtccagatgtgcggatgcgccaccgtggaaggtcacaactgactgcgcccacccgaccagcttcatcatttcactcccgtccatatgctgggcggagaacggaatggtcagcagacccagcgcgcactgaatcaccagcaatgagagaatcaaaatatctgcaccggtagtggtggcgcggacacgtgggctgaacagacgacgcttgagcagtaaaataccgccaaccagcgtcagcattccgcaggcgccgccggcaatcatcgccatcttctgcttcacgtcgaccggcagaaaagcttcatacatccagtgcggcgttaacatgcccaggaaatgaccggcgaaaatacccagaatcccaatgtggaacaggtttgacgccaggttcattcctttgcgatccagcatctgactggaagccgcccgccaggtgtactggccgtagtcgtaacgtaaccagctaccgatcagaaataccgatccggcaatgtacgggtagatatcaaagaagaacatattcaggaagtgcattagtgctgtcctccggtggtgatattcagatattgcggcgccacggccccggcaaaacgacgctggtgagcggagatttccgactcgccacacccttgatcggcgaagaatttcacctgctcttcttcccagaccgcatccaacgcctgcggggtatcatcacgtgcttcattcgcaattttttcagccactttgccgctgtcgataacggtattcgccagttttaacagcagatcgaacagcaccgcataacggctgtcacgctgttgcaaacgtgcgctgagcaacgccagaatcggcgcgatatcctgtaccccccctaacgcttcgcttttcggcaactgcgcaaggtattccagatacagcggcagatgatcgggcagttcgcggctgtcgagctgcaaaccgtgctgttcatactgtgccatcaggtcaaccatcgcctgaccgcgatcgcgggattccccgtgtacatgttcaaacagaagcagcgatgtggcgcgaccacggtcaaacagttcactataagcggcctgtacatccagcatgtcctgcgcggttaaatcgcgcaggaaaacgcccagagtctgggcatcctctttatccaggttctcagatgacgcgagcgcatcgaacaactcctgctgatgctgccacagggcagcatccgggtactcgagcagacgcgaaacaatgacgagttcaatcatgcgtgcggctccgttttgctggtcacatcaacagcgtcgatgcggcggctgttgaacagattgaatttggtatcagacccgtggcaaccatcgccgaaggtaaagccacaaccgcttttctccgggaatgcgtcacgcgccagttcacgatggctgctcggcaccacaaagcgatcttcgtaattagcaatcgccaggtaacgatacatttcctgcgcctgggcttcgcttaaacccacctcttccagcgcgcgggtatccactttaccgtctacggtttccgcacgtttgtagtgacgcatcgccagcatccgtttcagcgccaacagtaccggctgagtgtcgccagcggtcaacagattcgccaggtactgcaccgggatacgcagactgtctacatccggcagaataccgttgctgcccagttcacccgcgtcggcggcagactgaatcggtgacaaaggcggcacgtaccagaccatcggcagcgtgcggtattccggatgcagcggcagcgccagcttccagtccatcgccattttgtacactggcgattgctgcgccgcatcgatcacgctctgcggcacgccgtccttcagcgcctgctcaatgacagccggatcgttcggatcgaggaacacgtccagttgacgctggtacagatctttttcgttttccgtactggcagcgctttcaatggcatcggcgtcatacagcagtacgccaagataacggatacggccaacacaggtttcggagcaaacggtcggctgacccgcttcgatacgcgggtagcagaagatgcacttctcggacttcccgctcttccagttgaagtaaatcttcttgtacgggcagccggtgatgcacatacgccagccgcggcacttgtcctggtcgatcagcacgatgccgtcttcttcacgcttgtagatggcaccgcttgggcaggttgccacgcacgccggattgaggcagtgctcgcacaggcgcggcaggtacatcatgaaggtgttttcgaactggccgtacatcgccttctgcatgttttcgaaattctgatctttggcgcgtttttcgaactcgccgcccagaatctcttcccagtttggcccgctggtaattttgtccatccgctggccggtaatcagcgagcgcggacgcgcgatcggctgatgtttgctttccggcgcagtatgcaggttctggtagtcgtaatcaaacggctcgtagtagtcgtcgatgcccggcagatgcgggttagcgaagattttacccagcagcagcgcccggttgcccatgcgcggctgtagtttgccgttgattttgcggatccagccgcctttccatttttcctgattttcccagtcattaggaaaaccaacgccgggcttactttctacgttgttgaaccaggcgtattccataccttcgcgactggtccagacgtttttacaggtgactgaacaggtatgacagccgatgcacttatcgagattcagcaccatgccgacttgtgaacgaattttcattttacgctctcctgtacctggtcattgccttcgccatccaaccagttaatgttcttcatcttacgtaccaccacaaactcatcgcggttggagccgacggtaccgtagtagttaaagccgtaggctaactgcgcatagccgccgatcatatgggtcggtttcggcgtaatacgcgtcaccgagttatgaataccgccgcgctgctgggtaatttccgaccccggcaggtttacgatacgttcctgcgcgtggtacatcatggtcatgcccgccggtacacgctggctgaccactgcgcgtgcggtcaatgcgccgttgctgttgaagacttcgatccaatcgttatcttcaatgcccagctctttggcgtcggtttcactcatccatacaatcgggccgccacgcgacaaggtcagcatcaacaggttatcgctgtaggtcgagtggataccccatttctggtgcggcgtcaggaagttgagcgccttctccggattaccgttggatttacgccccatcaccgctttcaccgagcgggtgtcgatcggtgggcgatacaccagcagactttcgccgaagtcgcgcatccactggtgatcctgatacaactgttggcgaccagacagcgtacgccacgggatcagctcgtgaacgttggtataaccggcgttataagaaacatgctcatcttccagaccagaccaggtcgggctggagataattttgcgcggctgggcctgaatatcgcggaagcggattttctcttcttctttattagttgccagatgcgtatggtcgcgaccggtaaactcgctcagcgccgcccaggctttcactgccacctgaccgttggtttccggcgctaacgtcaggatcatctctgccgcgtcaatcgccgtgttgagcatcggctggcctttcgccggaccgtccgctttggtgtaattgagcttacgcagcaagtccatttcgctctgcgtgttccaggcaatccctttcccgccgttgccgattttctccatcagcgggccaatagaggtaaagcgctcataggtggccggataatcgcgctcaacggtcatgatgtgcggcgcggttttccctgggatcagatcgcattcaccttttttccagtctttcacgtccagcggctgtgccagttcagcggcagagtcgtgctggatcggcagcgtcacgacgtcagtctctttacccaggtggcctacacagacttcggagaatttcttcgcaatgcctttgtagatttcccagtcgcttttcgattcccaggccggatctacggcggcagacagcggatgaataaacggatgcatatccgaggtattcatatcgtctttttcataccaggtggcggtcggcagtacgatatcggagtacaggcaggtgctcgacaggcggaagtccagcgtcaccaccagatccagtttgccgtccaggccattgtcacgccattccacttcttccggcttcacaccgccctgcttgccgagatccagcccctgaataccatgctcagtacccagcagatatttcagcatatactcgtgacctttaccggaagacccaagcaggttggaacgccagataaagaggttacgtggatggtttttaccgttttccggctgctcggcggcaaagcgaatcgaaccgtctttcagggatttgacggtataatctaccggcgtcataccggctttttccgcttcacgcgcaatatacagcgggttggtgcctaactgcggtgccgacggcaaccagcccatacgttcggcgcgcacattgaagtcaatcagatggccgctatagcgggatttgtccgccatcggcgacagtaactcctcggcggtcaccgtctcgtagcgccactggctggagtggttatagaagtaagaggtgctgttcatgtgacgcgcgggacgctgccagtcaagggcaaacgccagcggctgccagccggtctgcggacgcagtttttcctggccgacgtagtgcgcccagccgccgccgctctgaccaacgcaaccacagaacaccaacatattgatcagcccgcgatagttcatatcgaggtgataccagtggttcagaccggcgccaacgataatcattgaacgcccgtgcgttttgtccgcgttatcggcgaattcccgtgcgatacggatgatctgcgcccgcggcacgccggtgatctgctcggcccatgctggcgtatatgctttggtatcatcataactggcggcacaattttcatcgttcaggccgcgttccagaccatagttcgccatggtcagatcgtaaacggtagtgactaacgctgaagaaccatcggccagttgcagacgttttgccggcagtttatgcagcaggacgttatccagcgccacatgattaaagtactctgaaccctcgccgccgaaatacgggaagcccacgtcagcaatctcatcctggctgcccagcaagctgagctgcaattcagtttctgcaccggtagtcccgtcgcgctgttcgaggttccatttgcctttttcgccccagcggaaaccaattgaaccgtttggcgccaccatttcaccgttgctgttgatagcgacggttttccattccgggttattttcctgccccagcgaatcaacgagatcggcagcgcgcagcatacgacctgcggcataataaccatcacgctcttcaagcatcaccagcattggcatgtcggtatagcgacggacataatcggtgaagtactggcgcgggttgtcgaggtggaactcgcgcagcatgacgtggcccatcgccagcgccatcgccgcatcggtcccctgcttcggcgccagccacagatcgcacagtttggcgatttcggcatagtccggcgtcaccgcgacggttttagtgcctttgtaacgtacttcggtaaagaagtgggcatccggcgtacgggtttgcggcacgttagagccccaggcgataatatagctggagttgtaccagtcagcggattccggcacgtcggtctgctcgccccaggtttgcggggaggctggcggcaggtcgcagtaccagtcgtagaagctcaggcaggtaccgccaatcagcgaaagataacgtgcgccggaagcgtaggaaaccatcgacatcgccggaatgggtgagaagcccgcgacgcggtcagggccataggttttcacggtgtacacgttggaagcggcgatcagctcgttcacttcctgccatgaggagcgaacaaagccgccacgaccacgcgcctgtttgaagcttttggctttatcggcatcttcaatgatggaggcccatgcctctaccggatcgcgatgcagttttttcgcctcgcgccacatcttcatcagacgtttgcgcattagcggatatttcagtcggttagcgctgtagagataccaggagtaacttgccccgcgcgggcagccgcgaggttcatggtttggcatatcaggacgggtgcgcgggtaatcggtttgctgtgtttcccaggtcaccagaccatttttgacataaattttccagctacaagaaccggtgcagttcaccccatgggttgagcgcacaattttgtcatgctgccaacgttggcggtatccgtcctcccagtcccggtttgtttcgagaagctggccgtgcccatcggcaaaggtttcgcccttctgcttgaagtagcgaaaccggtccaggaatttactcatcgggtttctcctgtgtggaaccttacggctctctgataaatcgacattgcttaactaagggcgaaggtaacgcgctgaatgggcgtgagaattgataacgatcaaggcggacagggatgcaaatggcgcgcaaacctccggcatactccttttggaggaggagttttatttatatatattactgatttaattacataaaattaaatttacgcacgacatgaatgttaaattttcaacaagtgggtattaaggggtatccccctggatgaccgataaaaatgtgcgtggtcagccctgtcgcgcctctcttcttgactataagtatgttgtaactaaatgcgggtaaaaaaaagcgcggtctaacgccgcgcaaaggataatcaaaagttactttttatttttagaatgacgtccatataccgcccaggtaataacgacgcaggcgatatagaaaataagaaagactttcatcgcgccgactggcgaaccggttaatgctaaagatgaaccaaacgctttcggaataaaaaagccgccaatcgcgccaatcgcggaaataaagcccagcgccgccgccgtatcggtcgccgcttcacgcatggctctttcgtccgacccgccttccgcttttacccggtccatcgtcagtttacggaagataacggagatcatctggaaggtagaaccactccccagccccgccgtcaggaatagcgccagaaataccccgtagaatgcgataaagctaccgccaacgccgccagtaggtaatgtcaggaacagcagaccgctgaaaatcgccatcaggacaaagttgataagcgtgacgcgagtcccccccagacggtcagaaattgcgccgcctgccgaacgcgccagcgcgccgataaacggaccgaaaaacgcataatgcaggatctgcacatccgggaattgcgttttagacagcatagcgaaccccgcggagaaaccgataaacgatccgaaggtcgccagatacagcagactcatgatccacagatgaccacgtttgagcaccggcagttgctcttttagcgaggccttagacgtcgccagttcgttcatgccgaaccacgctgccagcgtaaaaatggccaggaaaggcacccaaatccaggctgcgttcgccagatagagctgagaaccgtccggctgctctacaccgtggctgccaaaggcggcaaagatagagagcgaaaccaccagcggcgcaaccagctgcatcacgctcacgcccatattgcccagaccgccgttcagacccagcgcgccgccctgcttttgtttaggaaagaaaaagctgatgttcgccatactggaggcaaagttcgcgccggcaaaaccacacagcaaggaaataataatgaaagtgctaaatggcgtactggtatcctgaacggcaaagcctaaccatacgcaaggcacgatgaggataccggtactgaacgctgtccagcgacgtccgccaaatagcggcaccataaaggagtaaggcacccgtagcagcgcgccggaaacagatggcagcgcagtcaacataaagagctgatcggtcgtaaaattaaatcccactttcggcaggttcaccgccactgcgctgaatagcatccagacgcaaaacgccagcagtaaacacgggacagaaatccacaaattacggctagcgacacgatggccgcgctgctgccagaacgccggatcttccggacgccattccgtgataacagcgccagttgccctttccggggcggatgagtgactcatagacacctctgattcttgatttgatgtctgccacattagggtttactgccgaaggtaagttgatataaatcaaaggaaaagtcgtcatcaccggcgactaaaaatagttattacccttaatgagtaggctattttggtaaaaaagctgtggtttttcaccatgctgtgtctgtctactccttcccgtcgcagatacctctttacggcggcaattaaggagtaactcgttataggtatgggtatactccgctgtatcgttgagaatagcggcacagccgattgacgcccccttttttgctacgttttttcggcgacattaccccgaagaaagaaggtaacatgtttaaacggtgtttctctcctcttacgctggttaaccaactggcgctgattgtcatgctctctaccgctatcggcgtggcggggatggcggtttccggctggctggttcagggcgtgcagggtagcgctcatgcgattaataaagcgggctcattgcgtatgcaaagctatcgactactggccgctgtcccgctggatgctaaagatcaaaagctgctggatgagatggagcaaacggcattcagccctgaactgacccgcgccgctgagcgagacgggcagcagaagcagcttaaagcgttgcaggattactggcataacgaactctcgccaaggctacagcacgcgcaaaacgcgcacgcggtcgcagaagatatcacgcgctttgtggcgggcctggatcgcctggtgacgtcgttcgaccatacgactgaattgcgtatcgaacgagtggtattagttcaccgggtaatggcgatctttatggcgctattgctggtatttacgattatctggctacgtgttcgccttttgcagccctggaaacagttgttatcaatggcgcgcgccgtcagtcagcgcgactttacccaacgtgccaatatcagtggacgcaatgagatggccgcgttgggttctgcgctcaataatatgtctgaagaactggccgaaagttatgcagtactggaacagcgagtacaggaaaaaacagccggtctggaacataaaaaccagattctctcgtttttgtggcaagccaaccgccgactgcattcacaggctccgctatgtgaacgtctttcaccggtactgaatggcctgcaaaatttaacccagttgcatgatattgagctgcgagtctatgacctggaagatgaagataatcaccaggaatttacctgtcagtcggacatcagttgcgatgataaaggctgccacctttgcccacgtagcgccctgccgatgattaacggcggcaccaccttaaaatggcggctcaccgactctcacacccaatacggtattttgctggcgacgctgccctatggacgccatctcagccacgatcagcaacagttggtggacacgctggttgaacagcttaccgcgactctggcgctcgacaggcatcaggagcgccagcagcggttgattgtcatggaagagcgtgccaccattgcccgcgaactgcatgattctattgcccagtcgctctcttgtatgaagatgcaggtgagctgcctgcaaatgcagggcgacgcgttaccggaaagcagccgtgagttactcagccaaattcgcaatgagctgaactgctcctgggcgcaactgcgcgaactgttaaccactttccgcttacagttgacggaacccgggctacgtccggcgctggaggcaagctgccaggagttcagcgcccggtttggctttacggtaaaactggattatcagcttcccccccgcctggtgccatcacaccaggcgatacacctgttgcaaattgccagggaagcccccagcaacgcccttaaacactctcatgccgacgatgtggtggtgacagtgacgcaatgtggcaaacaggtcaaactaaaagtgcaggacaatggctgcggcgtcccggaaaacgccgaacgcagtaatcactacggcatgatcatcatgcgcgatcgggcgcaaagtttgcgcggcgattgccaggtacgccgacgcgagactggcggaacagaggtcactgttacttttattccagaaacaaacttcacagaaacccagggagatacccatgaataatcaggaaccggcaaccatcctgttaatcgatgaccatccgatgctacgcacgggtgtaaagcagcttgtgagtatggcgcccgatatcagcgtggtcggagaagccagcaacggtgagcagggtattgacctggcggaatcgctcgatcccgatctgatcctccttgatttgaatatgccgggaatgaatggtctcgaaacgctggataaattacgcgaaaaagcgctgtcaggacgtattgtcgttttcagcgtatccaaccatgaagaagatgtcgtcacggcgctaaagcgcggcgcggatggttatctgttgaaagacatagagccggaggacttgctcaaagcgttacaacaggccgccgccggcgaaatggtattaagtgaagcgttaacgccggtactggcggccagcctgcgggccaaccgcgctaccaccgatcgcgatgtgacgcaactcaccccgcgtgagcgcgatattctgaagctcatcgcgcagggattgccaaataagatgattgcccggcgtctggatatcaccgaaagtacggtcaaagtgcacgtgaaacatatgctcaagaaaatgaagctgaaatcgcgcgtggaggccgccgtctggatgcatcaggaacgcatcttttaattattgctcctggaacggttgccaatgcggattatcgtccggcatcgtgataaacggttcagtcagcgcgagcgtgatctcattggaagagacacgctgacctttttcatcctcaaccaccaccgataaacgccagcgatttgccgcgccttcgcggtgatcccaggccggcataatgattgtccagccctcggtactgcgggtgtccgttcctgccgtcaaacttaatgcctgtgtatcgccctgccagctcaaatgacgaataccgtgcacgctgcgcacctgcaattttaacgcaaccgtctcaccaggcgtaagatcccagggcggcgtcgccagaaaaaccgttaacgttttacgctgccgatactccattgtcggcagcgagttacgttgcggcgtatcatagcggctaccgcgtaatgactggctttgcgccacttcactggcggcaagctgctttttgagcggcacgccgaagcggtagttaagcgtcagccccaggttattctgactgaccccgctctcgccctgtttgtgctgggcggtcatagtaagcaaaggtactggcgtatagttgagacccagttttaacgcgacaggattgtgataccccgttccggagtcaaacagatccacgctatcgccaaagtactgctccagactaacgctggtattgatatgctggtaaaacggcagccgcacttgcgcgttgatatcatatccgcgcgccattcgctgttctaaggtcgccgtatgcgtctgccagtcggcaaaaggctgataatagttggcggataaacgcaaatattctccccacgcctccgcgccaaagccggcgcgctgcagattttcatccagcagattatcgtaaaaggtattatagccaagaagccagccatcctgcgcccagcgctgtcctatgccaacgttgcttaccagtccgtcagtctgttgcgtaagaccaagctggctccaggtcagatagcgctgtttatcctgtaaagggataaaccagcttccgcgactgccgttaaaatgaccttcgttatcgacgttaatatccacgctggcgctgccccaggctgatagccagctttcaagctgctggttaacctgctcgctgaccacatcgcgtacctgtccgaaagcgaattgccgcgcctgttcaccggtatccagatcgttatttttcatgctggcttcgctaaacgctttggccatctcggcaaaatgcttttccccttcgtgggattccggcatcatgcctaaatccggcagacggttttgatcgaaagggtcttgcgcctgcgcacggatcgtaccgctggcagccagcaagagaagcgagagtgagaatgaacgaaaaacaatacggctcaacgtgtcggcaacttctacaacaaaagataagaggaatggcatcagagtaaaccataacgtgtccggacaggttttgcagccttttctcgtgtttccaggaatatccttattttttccgcagagcgtcccgggattttctccacgcatttggcggtacccggttcccgaggtaacataacgccattgccgacaaaatttctcaaggagaagggttatccatgcaaaatatcgtcattatcgctaacggcgccgcctacggcagcgaatcattatttaatagcctgcgtctggccattgcgcttcgcgagcaggaaagccatctcgatttacgcctgtttttgatgtcagatgccgtaaccgcagggttacgcggtcaaaaaccagccgaaggctacaatattcagcaaatgctggaaattctaaccgcgcaaaacgtaccggtaaaattatgcaaaacctgtgcggacggacgtggtatcactcccctgccgctgattgacggtgtggaaatcggaacgctggtcgagctggcgcaatggacgctggcggcggacaaagtgctgacattttgaatctgtacgcgggaaaagctcccgcgtcaggatagacttccggcaagaaaatcaggctaacgcgtgagtaataccgcgtttattttttcttatgccatttatcatcctcgcctttttcataatcgtttttaaccgccgcccaagcgactttgtgtgcggtttcctcgcgactggcgtcatcacgacgatcggctttatctttatattgctcccaggcgctattaaacgcttctttgtaaatgtcctgggcatgggctggaagaacattccgcacattatcgggtaaatcacttttggctttatacggcatcagcgcctccgtcttcagggaaaacattaagtgtggtaaacaatgcgttattacgccagtcgaggaggatttttgctttttacggaaattaactttttgttatttaaacactgttaaaacaagatacttgttttactgaccttgaaagaaaaaaatcgtctacgccgtaaaactacgtaaaaaaccactaaaaaaatacaaatttctgctatttttaccttctttactctttccaaaatattaacacctgcacaagggagacccacatgacacatgcctgtgaggcggtgaaaacccgccataaggagacttcgcttattttcccggttcttgcgctggtagtgctgttcctttggggaagtagccagtcactaccagtggttattggcatcaatatccttgcacttattggtattttaagcagcgcatttagcgtggtccgtcatgccgatgtattagcgcaccgactcggcgaaccctacggatcgcttattttaagcctgtccgtcgttattcttgaggtgagtttaatttccgcgctgatggctaccggcgatgctgcgccaacgcttatgcgcgatacgctctactctattattatgattgtcaccgggggactggtcggtttttcgttgttgttgggcgggcgtaaattcgcaacgcaatatatgaatttatttgggattaagcagtatcttatcgcgctatttccgctggcgattattgtgctggtttttcccatggcattgccgcaagccaatttttctactggtcaggcattattggtcgcgttaatttccgccgcgatgtacggcgtatttttgttgattcaaaccaaaacgcaccagagcttatttatctatgaacatgaagatgaaggcgatgatgacaatccacaccacggtaaaccctccgcgcacagtagcggctggcatacggtctggttactcattcatttaattgcggtcattgccgttaccaaaatgaatgccagcccgctggaggcgttgctgaccagcatgaacgctccggtcgcctttaccggtttcctggtcgcgctgttaattctctcgccggaaggactgggcgcgctgaaggcggtactgaataatcaggttcagcgggcaatgaatctgttcttcggatcggtgttggcgacgatttcattaaccgtgccggtcgtcacgctcatcgcatgggcgacaggtaatgatctggtgtttggtttaggcgcgccggaaatggtagtgatggtggcctcgttagtgctgtgccatatttcgttctctaccggacgcaccaacgtgctaaacggcgcggcgtatctggctttatttgccgcctatctgatgacgatttttgcctgatataaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataaaaacggggacgttaagcccccgtttttgtttttaacaattatcgatattacatatttgcgataatcgcgtcgccaaactcactacatttcagcagcttagcgccgtccatcaggcgttcaaagtcataggtcacggtcttcgcggcaatcgcgccttccatacctttaacaatcagatccgccgcttcgaaccactgcatgtggcgcagcatcatctccgcagacagaataatggagcctgggttgactttatcctggcccgcatatttcggcgcagtcccgtgagtcgcttcaaacaacgcgcattcgtcgccgatattcgcacccggtgcaataccgataccgccaacctgagccgccagggcatcggaaatatagtcaccgttcaggttcatacaggcgataacgtcgtattccgccggacgcaacaggatttgttgcaggaacgcatcggcgataacgtctttaaccacgatctctttacccgtgttcgggttcttaattttcagccacggaccgccgtcaataagctcaccgccgaactcgtcgcgcgccaactggtagccccagtctttaaacgcgccttcggtgaacttcatgatattgcctttatgtaccagcgtgacggaatcgcgatcgttggtaatagcgtattcaatcgccgcgcgaaccagacgtttagtgccttcttcagaacacggtttgataccgataccgcagtgctccgggaagcgaattttcttcacgcccatctcttcgcgcaggaacttgatcactttctcagcgtctgcagagtcagctttccattcaattccggcgtagatgtcttcagagttttcacggaagatgaccatatcggtcagctccggatgtttcaccggacttggcgtgccctgatagtaacgaacgggacgcagacaaacgtacaggtcaagctcctgacgcagggcaacgttcagagagcggataccgccgccaaccggcgtggtcaatggacctttaatcgctacgcggtagtcacgaattaaatcaagggtttcagcgggaagccagacatcctggccgtaaacctgtgtggatttttctccggtgtaaatttccatccaggaaattttacgctcgcctttataggctttctcgacggcggcatcgaccactttaagcatggctggagtgacatcaacaccgataccatcgccttcaataaacgggataatcggattctcaggaacgttgagtttgccgttttgcagggtgatcttcttaccttccaccggaacaactactttgctttccattcacctctccttcgagcgcttctggtttgctcgtctgtcatcgcgctgcatgtgcaatggcgtcctgctgcacgactgcgttagagcaattttttgttaatgttttgtaatgagcatgtcaatactaccctattgtttgccgccatgaaagacactcattattgcgctataatgcggcaattaataagttctgaaaacaccatgcaaaaaacttcttttagaaatcactacgttaagcgattcagctcacgacaagcatctaaatcacggaaagaaaaccagccaaaacgcgtggttttgttcaataaaccttacgatgtgttgccgcagttcacggatgaagcaggtcgccgcacgttaaaagattttattcctgtgcaaggcgtttatgccgcaggccgcctggaccgcgacagcgaagggcttttggtgctgactaatgacggcgcgctgcaggcgcgcctcacgcaaccgggcaaacgcaccggcaagatttactatgttcaggtagaaggcatcccggataatgcagcgctgcaggcgcttcgtactggcgtcacgctcaacgatggccctaccctgcccgccggtattgagattgtcgcggagcctgactggctgtggccgcgcaccccgccgattcgcgaacggaagaatattcccaccagttggctaaaagtcaccttatatgaaggccgcaaccaccaggtaagacgcatgacagcgcatgtcggtcatcccactctacgattaattcgttacagcatgggcgactacacgctcaacggcctcgataatggacagtggtgcgagatcgcacaggagaaagacagatgaaacggcttctcattgcttttgctttattaacaccgttatccgttaatgcggccagcttcgactgccagaaagcgcaggctgcggatgaaaaggctatctgcgcgcacctgacgctgaatgataaagacgtggaaatgcacaccaaatatcagtttctgaaagggttgttcgcgatgggcagtcgcggcgcgctgcaggacgcccagcagagctggcttaaacagcgtcagcagtgcaaggccgacgtcacctgcctgacaaaagcttataacgagcgtctgaaacagcttgacgcgatctatgaccacattgataaaccgctttaataaggatgcctatgttcaagccgcacgtgaccgttgcctgcatcgtacatgccgaagataaatttctggtggtggaagagaccatcaacggtaaatcgttatggaatcaacctgccggacacctggaggcagatgaaacgctggcgcaggccgccgcgcgagaactgtgggaagagactggcatcacggcgcaaccacagtattttatccgtatgcatcagtggattgcgccggataaaaccccgttcctgcgctttttattcgctatcaagcttgatcatatttgcgcgaccgccccccatgacaatgacatcgattgctgccgttgggtgagcgccgacgagattctgaacgcgccgaatttacgttctccgctggtggctgaaagcattcgcagttatcaaacgggacaacgttaccccttatctatagtgggcgaatttaactggccgtttacagagggtgtcaagtaaagggctgcgtgatagaatacgccgccttgaagttcaatgtcgcgagtattccaatgtcagaaagcccaaaaaaagtgatcgtcggcatgtccggcggtgtcgattcctccgtttccgcctggctgttgcaacaacagggttatcaggtagaaggcctgttcatgaagaactgggaagaggacgatggtgaggaatactgcaccgcggcagccgatctggctgacgcgcaggccgtgtgcgacaagcttggcattgaactgcataccgttaattttgccgcagaatattgggataacgtctttgaactgttccttgaagagtacaaagcgggccgtacgccgaatccggatattctgtgcaataaagagatcaaatttaaagccttccttgaatttgccgcagaagatttaggcgccgactatatcgccaccggtcactacgttcgccgcgcggatgtaaacggcaaaagccggttgttgcgcgggctcgacggtaacaaagatcagagctacttcctctatacgcttggccatgagcagattgcgcaaagtctgttcccggttggcgagctggaaaaaccgcaggtgcgtaaaatcgccgaagatttggggctggtaaccgccaagaaaaaagattctaccggtatctgctttatcggcgagcgcaaattccgcgactttttagggcgctatctgcctgcgcagccggggaaaatcattactgttgacggcgatgaaatcggcgagcatcagggtctgatgtatcatacgctcggtcagcgtaaagggctgggaattggcggcaccaaagacggtagcgaagacccctggtatgtggtggataaagacgttgaaaacaatgtgttaattgtcgcccaggggcatgagcacccacgcctgatgtcggtaggcctcatcgcccagcagctacattgggtcgatcgcgaaccgttcaccggcaccctgcgctgtacggtaaaaacccgctaccgccagaccgatattccgtgcacgattaacgcgctggatgacgatcgtatcgaggtcatttttgacgagccggttgccgccgttacgccgggccagtccgctgtcttttacagcggagaagtctgcctgggcggcggcattatcgagcagcgactgccgctgacggtctgattattcaatacacaacaccattcaagtcacctcaaagcggcttaaaagatgaagtgtattttatttgatacaaggaagcagtgattgtggcaaagaattattatgacatcaccctcgcgctgtctggcatttgccagtcggcacgcctggtgcaacaactggcgcaccagggacactgtgatgccgacgcgttgcacgtttcactcaacagtgtcattgatatgaatcccagttctactctgggcgtgttcggcggcagcgaagctaacctgcgtcttggtctggaaacactgctcggcgtgctgaatgccagcagccgacaaggacttaacgccgaactgacgcgttatacgcttagcctgatggtgctggagcgcaagctgtcatccgccaaaggcgcgttgaatacgttaggcgatcgcattaacggcctgcagcgccagcttgaccattttgatttacagtcagacacgttaatgagcgccatggcgggcatctacgtggatgtgattagcccattgggcccgcgcattcaggtgacgggctccccggccgttctgcaaagtccgcaggtgcaggccaaagtccgcgcctcgctactggcaggcatccgtgcagccgtgctctggcatcaggtaggcggtggtcgcctacagcttatgttttctcgtcatcgcctgacgactcaggcaaaacaaattcttgcttatttaaccccggagttatgatctatggaattatcctcactgaccgccgtttcccctgtcgatggacgctacggcgataaagtcagcgcgctgcgcggaatttttagcgaatacggtttgctgaaatttcgtgtacaagtcgaagtacgttggctgcagaaattagccgcgcacgcagcgatcaaggaagttcctgcttttgctgccgacgcaaacggttacctggatacgcttgtggcaaacttcaatgaagaagatgccgcgcgcattaaaaccattgagcgcaccacgaatcacgatgtgaaagcggttgagtattttctgaaagaaaaagccgccgcgatcccggcgctacatgacgtttccgaatttatccactttgcctgcacctctgaggatattaacaacctgtcgcacgcgttaatgctcaaaactgcgcgcgatgaagtgatcctgccttactggcgtcaggtgattaacgcggttaaagatctcgccacgcagtatcgcgatattcctctgctctcccgcacccacggccagccggcaacaccttccactctgggtaaagagatggcgaacgtggcgtatcggatggagcgtcagttccgccagctcaatcaggtggagatcctcggtaaaattaacggcgccgtaggcaactataacgcgcatatcgccgcctatccggaagttgactggcatcagttcagcgaagagttcgtcacctcgctgggcatccagtggaacccttacaccacccagattgaaccgcatgattatattgcggaactgtttgactgtatcgcgcgctttaacaccatcctgatcgatttcgatcgcgatgtctggggctatattgcgttgaaccatttcaaacagaaaaccatcgccggagagatcggttcttctaccatgccgcataaagttaaccccattgactttgaaaactcagaaggcaacctcggtctgtctaatgcagtgttgcaccatctggcaaacaaactgccggtttcccgctggcagcgcgatctgaccgactcaaccgtcctgcgtaacctgggtgtcggcatcggctatgcgcttatcgcttatcagtcgaccctgaagggcgtcagcaagctggaagtgaaccgcgatcatctgcttgacgaactggatcacaactgggaagtattagccgaaccgatccagaccgtcatgcgccgctatggcattgaaaaaccatatgaaaaactgaaagagttgacccgtggcaagcgtgtcgatgccgaaggaatgaaacagcttattgatagtctggccctgccggaagcagaaaaaacgcgccttaaagccatgacgccggcaaattatatcggtcgcgctgtgaatctggtcgacgaacttaaataatgtgtgcctcaccctcttttcttcagaaagagggtgactatttgtctggtttattaactgtttatccccaaagcaccataatcaacgctagactgttcttattgttaacacaagggagaagagatgatgcgcgtactggttgtagaggataatgcattattacgccaccacctgaaggttcagctccaggattcaggtcaccaggtcgatgccgcagaagatgccagggaagctgattactaccttaatgaacaccttccggatatcgctattgtcgatttaggtctgccggatgaagacggcctttccttaatacgccgctggcgcagcagtgatgtttcactgccggttctggtgttaaccgcgcgcgaaggctggcaggataaagtcgaggttctcagctccggggccgatgactacgtgacgaagccattccacatcgaagaggtaatggcgcgtatgcaggcgttaatgcgccgtaatagcggtctggcctcccaggtgatcaacatctcgcctttccaggtggatctctcacgccgggaattatccgtcaatgaagaggtcatcaaactcacggcgttcgaatacaccattatggaaacgcttatccgtaacaacggtaaagtggtcagcaaagattctctgatgcttcagctgtatccggatgcggaactgcgggaaagtcataccattgatgttctcatggggcgtctgcggaaaaaaatacaggcccagtatccgcacgatgtcattaccaccgtacgcggacaaggatatctttttgaattgcgctaatgaataaatttgctcgccattttctgccgctgtcgctgcgggttcgttttttgctggcgacagccggcgtcgtgctggtgctttctctggcatatggcatagtggcgctggtcggctatagcgtaagttttgataaaaccacgtttcgtctgctgcgcggcgaaagcaacctgttttataccctcgccaaatgggaaaataataaaatcagcgttgagctgcctgaaaatctggacatgcaaagcccgaccatgacgctgatttacgatgaaacgggcaaattattatggacgcagcgcaacatcccctggctgattaaaagcattcaaccggaatggttaaaaacgaacggcttccatgaaattgaaaccaacgtagacgccaccagcacgctgttgagcgaggaccattccgcgcaggaaaaactcaaagaagtacgtgaagatgacgatgatgcggagatgacccactcggtagcggtaaatatttatcctgccacgacgcggatgccgcagttaaccatcgtggtggtcgataccattccgatagagctaaaacgctcctatatggtgtggagctggttcgtatacgtgctggccgccaatttactgttagtcattcctttactgtggatcgccgcctggtggagcttacgccctatcgaggcgctggcgcgggaagtccgcgaacttgaagatcatcaccgcgaaatgctcaatccggagacgacgcgtgagctgaccagccttgtgcgcaaccttaatcaactgctcaaaagcgagcgcgaacgttataacaaataccgcacgaccctaaccgacctgacgcacagtttaaaaacgccgctcgcggttttgcagagtacgttacgctctttacgcaacgaaaagatgagcgtcagcaaagctgaaccggtgatgctggaacagatcagtcggatttcccagcagatcggctattatctgcatcgcgccagtatgcgcggtagcggcgtgttgttaagccgcgaactgcatcccgtcgcgccgttgttagataacctgatctccgcgctcaataaagtttatcagcgtaaaggggtgaatatcagtatggatatttcaccagagatcagttttgtcggcgagcaaaacgactttgtcgaagtaatgggcaacgtactggacaacgcttgtaaatattgtctggagtttgtcgagatttcggctcgccagaccgacgatcatttgcatattttcgtcgaagatgacggcccaggcataccccacagcaaacgttccctggtgtttgatcgcggtcagcgcgccgataccctacgaccaggacaaggcgtggggctggctgtcgcgcgcgagattacggaacaatacgccgggcagatcattgccagcgacagtctgctcggtggcgcccgtatggaggtcgtttttggccgacagcatcccacacagaaagaggaataaacatttctgtgcgttcttccacgcatctcgttaagcatccgttataatcggtgtcagataccagcctgcggatacttaacatggaataccaattaactcttaactggcccgactttcttgaacgccactggcaaaaacgcccggtggtcttaaaacgtgggtttaccaactttattgatccgctctcgccggatgagctggcggggctggcgatggaaagcgaaatcgacagccgtctcgttagccatcaggatggcaaatggcaggtcagccatggccctttcgaaagctacgatcatctgggtgagagcaactggtcgctgctggtacaggcggtaaaccactggcatgaacccaccgccgcgctgatgcgcccgttccgcgctctgccggactggcgtatcgacgatctgatgatctccttttccgttcccggtggcggcgttggcccgcatctggatcagtatgatgtgtttattatccagggaaccggtcgccgtcgctggcgcgtgggcgaaaagctgcaaatgcgtcagcactgcccgcatcccgacctgttacaagtcgatccgttcgaggccattattgacgaagagctggagccgggcgacattctgtatattccgcctggattcccgcatgaagggtatgcgctggaaaacgccatgaactattcagtcggttttcgcgcgcccaatagccgtgagctgatcagcggttttgccgattacgtcctgcaacgggatctgggcaacacatactacagcgatccggatatgccgtcccgcaaacatccggcggatatcctgccgcaggagatggataaactgcgtaatatgatgctcgatttgatcaatcagcccgcgcatttccaacagtggcttggcgagtttatctctcagtcacgccacgaactggatattgcgccgccggagccgccgtatcagccagacgaaatttacgatgccttaaagcaaggcgaggcattagtacgtctcggcgggcttcgcgtattgcgtatcggcgatgaagtctatgcgaatggcgaaaaaatagactctccgcatcgccccgctctggaagcgctcaccagtcatattgtactgaccgctgaaaacttcggcgatgcgctggaagacccttccttcctcgcgatgctggcggcgctggtgaatagcggatactggtttttcgaaggataagaacatcgcaatgcccggcgaccgccgggctgacgcaaactatccacaacgatcgccgccaggtttggcgaaatcgttatattgcggatcgcccggataaatcgagtgggccattcgatggcgaaatgacatttgccgatagcgccgcgcctgcgcgttatctccaagaccttcggcaatattagccagttgctgtaatcgttcatactgcatctttgctggataagctacggcatcaagcgtaaaggcgcgttccgcaaagtcttttgcttgttcaagctgttgattattcttataaagcagcgaaataccatacaacaccatggatacgtcggactgccgacgtttatattcttccagcaatgggagatagggggaggtactgtccaggtcgatgttttcgggcaaataaaagcgtaatcgtgatattaccgtcgccattggcgttaaacggctctggtaatacgcgataagtttaaggtagagatctttcgcttccttataatgatggccctgtgcataaaagccagcaagattattgctgtcaaccgtcatttcgccgaattcggtgccataaagcgtttgctcaatttttagcgcctgacttagcgcattaatcgcctcgctaatatgccctgcattataagcaatatccgctttctgctgcaaaaaagaggcgacgcgctcacgattatcccaggttttatcccgtaaaataacgctcagccactgccgctccgctgcgtctatcttcgccaaataataggctttacgcgcactatcacattcgacatcccgctcttccagcgcatcagaataagcgtcgcgcatcctgtttaaggtataaaccaacgcttccgtcgatgtctttttgtctttaagacgccacgttaatgcctgctcttgccaggctatccgctgacggtaatcaaccttgatctcgtatcgccactgctctgtcggtgaatactctatatggcgatcgtcaccgtaaacataaaaggccgccaggtgttcaaacatatcggcccgatcgcccggataagtgcccgccggaaatgttttcatgattgcccgcgctcgcagcagcatttgcggcgttaactccggtttacccagccattgataaatatcgctttgtaatagcaggctacgaacaagctgtattgagcgtttgccatattgccgcgaggccagcctcaccgcatcatcaataaacgtcatgcaggtttcatcgccggtcataaaacatgctgcagattgttgctggcgctgggaccaggaaggcgtatattcggcgctccaggcagaaaaatttatggcggaaaatatcccgccataaataataaaacgcttcaccacaatgtgtaacattcgctactggccgcgcttacccgtcagctccgcgatacgtacaatcacctgtaccgctttttccatcccctccagcgtcacaaactcatgtttaccatgatagttatatccgccggtaaagagattaggacacggcaggcccataaacgacagttgcgccccgtctgtaccgccgcgaattggtttcatctccggcgtaatatgacagtcgcgcatggcctgctgggcgatatcgagaatatgcggatgctcaaccactttttcgcgcatattgtaataactgtcttcaatcaccagttcgatatagcagtccggatgcagccccttgccgacttttttggcaatctccatcattttgcgtttacgcgcttcaaactgcttacggtcgaaatcgcgaatgatgtagtgcatttcggcccggtcaacggtgcctttcatgctggccagatgataaaacccttcgtaaccttcagtggtttcaggcgcttcatccgccggcacttccgcgtgaatcctcgccgccaacgacagcgcattgaccatcacgcctttcgccgtaccaggatgcacgttattgccgacgattttgatattcaccgaggcggcattgaagttttcaaactccagttctcccacgccgccgccgtcgaccgtataggcccactgcgcgccaaattcctcaacatcgaagtgcttcgcgcctttccctacctcttcgtcaggcgtaaacgccactttaatttcgccgtggggaataggattacctttcagcaccgccagcgcggtcatgatctccgcaacaccggctttatcgtccgcgcccagcaatgtcttaccatcggtagtaatcagcgtctgtcccagtaattgatgcagtaccgggaacatcacgggtgacaacacctcatcgccaatccctaatgctatatcgccgccgcgataattctcgacaatctgcgggttaacgtttttaccgctgaaatccggagaggtatccacatgggagataaaaccaatggcgggaatatccccctcaacattggccgggagcgtcgccatcaacgtccctttttcacttaatgtaatgttaaccagccccatctcttcgagctgctgtttgagcaaacgtagtaacttccactgcccctcagtgctgggaacctgccgaacacccgactttgattgggtatccagcgatacgtagtgtaaaaaacgctcaagtagtttatccatgcagtcaccctcacttttcgtgacaacattattaataagcaagaaaagacaaatattgcgtcaggtcacttttatccctgcaaacaagaatatttcactttgacacgctttctgactataaagctaagtcagtaattcgcaacaaggattggcgatcacggtggtttgccgtagaatgaccgccctcattaagagtgattaaggtggttaaccacaaaccccgcagcggtcagccatccgttgcgtttacatgggacagagtaagaaattgaataaacaaccgcgttcgctttcaccgctggtgcttttgtcgggaattagcaaaagtttcgatggcaaagaggtcatttcacagctggatttgaccattaacaatggcgaattcctcacgctgcttggcccttccggctgcggtaaaacaaccgttcttcgcctgattgccggcctggaaaccgttgatgccgggcatatcatgttggataaccaggatatcacccacgttcccgccgaaaatcgttatgtaaataccgtatttcaaagctacgctttatttccgcatatgacggtgtttgaaaatgtcgcgtttggcttacgaatgcaaaaaacaccagccgccgagatagcgcctcgcgtgaccgatgcgctgcgtatggtgcagcttgaagagtttgcacaacgtaaaccgcaccagctttccggcggacagcagcagcgtgtggctatcgctcgcgcggtggtgaataaacctcgcctgttattactggacgaatcgctctccgcgctggactataaattgcgcaaacaaatgcagaacgagcttaaagcattacagcgtaaactcggtatcacgtttgtttttgtcactcacgatcaggaagaagcgctcaccatgtccgatcgtatcgtggtaatgcgtaatggcgtgattgagcaagacggcacgccgcgtgaaatctatgaagagccaaaaaacctgtttgtcgccggttttatcggcgaaattaaccgctttgacgcaaccgtcattgaacggcttgatgaacagcgcgtccgcgccagcgtagaaggtcgggagtgcaatatatacgtcaatttcgctgtcgaactgggccaaaaactgaacgtcctgctgcgaccggaagatctacgcgtcgaagagatcaacgatgataaccacatcgaagggcttatcggctacgtgcgcgagcgcaattacaaaggtatgacgctggagtcggtggttgaactggaaaatggcaaaatggtgatggtcagcgaattcttcaacgaagacgatcctgacttcgaccattcacttgaccaaaaaatggccattagttgggtagaaagctgggaggtcgtactggctgatgaagaacacaagtaaattccagaatgtagtgattgtcactatcgtcggttggcttgtgttgtttgtttttctgcccaacctgatgatcattggcaccagctttctgacccgtgacgacgccagtttcgtcaagatggtctttacgctggataactacgcacgcctgctcgatccgctctattttgaagtgctcctgcactctctgaatatggcgctgatcgccaccctctcctgcctggtgctgggctatcctttcgcctggtttctggcgaagttaccggaaaagatacgtccgttattgctgtttttgctgattgttcctttctggaccaactcactgatccgcatctatgggctaaaaatattcctgagcactaaaggttatctcaatgaattcctgctgtggctgggcgtgattgatacgccgattcgcatcatgttcaccccgagcgccgttattatcggcctggtttacattttgctgccgtttatggtcatgccgctctactccagcattgagaagctcgacaaaccgctactggaggccgctcgcgatctcggtgccagtaaaatgcaaacgttcatccgcatcattattccattaaccatgccgggcattgtcgccggttgcctgctcgtgatgctaccggcaatgggcctgttctacgtctccgatttaatgggtggcgcgaaaaacctgctgattggtaacgtcattaaggtacagttcctgaatattcgcgactggccgtttggcgcggctaccagcattacgctgaccattgtgatgggactcatgctgttgatttactggcgggcttcccgcttattgaataagaaggtgagtgatataagcgattaattgcgcaacgctaacaaatccacacgcatccaggcatgaagtttattcaagggtaaacttcatgcctccggcataaaaaacgcatgaaagaagttgccgccagtattgcaaatctacaacatcatccgcggtaggccttcttttatttttacctgtagcgacgctatcgcagacagtaatgcgtttatacgcgaagctctcaggttttatactgattgccagtctcttttaaaaattatattacatccgatgcgcccgcagttgagataaaaagagttgatttaatcaattatgtagtcatttttactccagtataagtgagattaatatgccgattactatagggaatggttttttaaaaagtgaaatccttaccaactccccaaggaatacgaaagaagcatggtggaaagttttatgggaaaaaattaaagacttctttttttctactggcaaagcaaaagcggaccgttgtctacatgagatgttgtttgccgatcgcacccccacacgagagcgatttacagagattttttttgagttaaaagagttagcctgcgcatcgcaaagagatagatttcaggttcataatcctcatgaaaatgatgacacgattattcttcgcatcatggatcaaaacgaagaaaacgaattgttacgtatcactcaaaataccgatacctttagctgtgaagtcatggggaatgcttattttttaataaaagatcgccccgatattttaaaaccgcatccacaaatgacggccatgattaatagaagatatagcgaaatcgtagattaccccctcccttcgacattatgtctcaaccctgctggcgcgccgacattatcggttccattagacaacatagaggggtatttatattctgaatggagaaaaggaaatttagatgagtggaaaacgcaagaaaaggcaacctacctggcagcgaaaattcagtctgggattgaaaagacaacgcgcattttacagcatgcgaatatatccgaaagtactcagcaaaacgcatttttagaaacaatgacgatgtgtggcttaaaacagcttgaaataccaccaccacatacccacatacctattgaaaaaatggtagaagaggttttactggcggataagacgtttcaggcgttccttgtaacggatcccagcgccagcctaagcatgttagctgagatagtcgaagccatctctgatcaggtttttcacgccatttttagaatagccccccagtctatacaaaaaatggcggaagaacagttaaccacgctacacgttcgctcagaacaacaaagcggctatttatgttgttttttataaaatcagacgacgctttctcagacgtcacgttcagggtttactcacgtacttcatgtttgcctacagagtaacctcttgcctggcgcaataatgccgcatatgaccggatcggatgagaatagtcatttaaatggcctttttttcccgctcgtctggcaatttgttgtaaaattcgcggcttcaagcggcagcttgcttcttcctggctgctgataaccgcgagacgttttggagagattttggagaagagaaaaaattgatcattttcaatactctaaaagcaccccatcctctgaataagaaggtggaacttgaatgatcggtcggctgctccgtggcggtttcatgactgccatctatgcgtatctgtatattcccatcattattctgatcgtgaactccttcaacagttcgcggttcggcattaactggcagggctttaccactaaatggtacgaactactggtcaataacgacagtctgttacaggccgctcaacattcactgacgatggcgattttctcagcgaccttcgccacgttgattggctcgttaaccgcggtagcgctttatcgctaccgctttcgcgggaagccattcgtcagcgggatgctgtttgtagtaatgatgtcgccggatatcgtgatggcgatctccctgctggtgctgtttatgttactcggcattcaactgggcttttggtcgttgctgttctcgcacatcacctttagcctgccgtttgtggtcgtcacggtctattcgcgcctgaaaggctttgatgtcagaatgctggaagccgcaaaagacctgggggccagtgaggtaacgattttacgcaaaatcattctgccgctggcgatgccggcggtggcggcgggctggttgctgagctttacgttgtcgatggacgatgtagtagtctcgtcgtttgtcaccgggccgggctatgaaattttacccttaaagatttattccatggtaaaagtcggcgtttcaccagaagtgaacgcgctggcgaccgttttattggtgctgtctctggtaatggtcattgccagccagcttattgctcgtgataaaaccaagggccgataaggcccgtaattcaggggacgttaaatgaaaaaatggtcacgccacctgctcgcggcaggcgccctggcgctgggtatgagtgccgctcatgcctccgacaacgacacgctctatttctataactggactgagtatgtaccgccgggcctgctggaacagttcactaaagagacaggcattaaggtgatttattcgacctacgagtcgaacgaaaccatgtatgccaaactcaaaacctataaagatggcgcgtatgacctggttgttccttctacatactatgtcgacaaaatgcgcaaagaaggcatgatccagaagatcgataagtcgaaattaaccaatttccacaacctcgatccggaaatgctcaacaaaccgtttgaccccaacaacgattattctgttccgtatatctggggcgcaacggcgattggcgtgaacagcgatgctatcgatccaaaaaccattaccagctgggctgatttgtggaaaccggaatataaaaacagcctgcttttaaccgacgatgcgcgagaagtcttccagatggcgctgcgcaagctaggttattccggtaacactaccgatcctaaagagatcgaagcggcatatgaagagttgaaaaaactgatgccgaacgtagcggccttcaactccgataatccggcgaatccgtatatggaaggggaagtcaatctggggatggtgtggaacggttcggccttcgttgctcgtcaggctggcacgccgctggaggtcgtctggccgaaagaaggcggtattttctggatggatagcctggctattccggcaaacgcgaaaaataaagagggcgcgctgaagctaatcaacttcctgctgcgtcctgacgtcgcgaaagaggtggcagaaaccatcggctaccctacccccaacctggcggcgcgtaagctgttaagcccggaggtcgccaatgataagtcgctctatccggatgcgcaaaccatcagcaaaggcgagtggcaaaacgatgtcggcgacgccagcgccatttatgaagagtattatcagaagctaaaagcaggacgctaattcagccaaagcgcctgtcgggcctacagatgaacgtaacgtgaaatgtaggccggataaggcgttaccgggcaaacggcactacagccctttcaggaatttatcaacaaattccggcacaacctggcttgccgggccgtagtgcttctcttcaaactcgctgccgacctggcttggctcaagattcagttccaccgtatgtgcgccgtgcagttttgcttcatgcacaaaacccgcagccggatagacatgaccggatgtgccaatggcgataaaaatatccgccatcgacagcgccatataaatttcatccatgccaagcggcatctcgccaaaccacaccacgtgcggacgtagcggcgccgggaactggcagcagtgacatttatcttccggcatcacatcgccgttccattccagaatctggccgctttgcgaacagcgcaccttcaacagctcgccatgcatatgaatgatgttgcggttgcccgcgcgttcatgcaaattgtcgatgttttgcgtcaccagcaaaaagcgatcgccaagcgcttcttcaagcttcgctaacgccagatgcgccgcattgggttgtatttccggctgttgaagctgctgacggcgggcattataaaatgtctgcaccagccccggattacgggcgaatccttccggcgttgccacgtcttcaacccgatgctcttcccaaaggccatccgccgcgcgaaacgtacgaataccagactctgcagaaattcctgcacctgtaaggactaatactcttgggttttccatcatttccggcaccactctgtctctgaaaaagatccgctggcgcagacgttcacgcaacagacgtttatttttacgaaagcggcttaatcgatgaaaccgacgcgactgcataacaacctctttttttgattagtcggtaagatgtaaaaaagcagcaccgcgcatcccacctgcatccccatgccgcgcacgctcaatgcgcggcgcgcgggcaacagggaggagatggcgcggcagtctttccgccagttgcgttgttattgccgtaaagttcgatagtccgccgccgatcaccaataaatcgggatcgacaatcgtcagtatattccccagacaaaccgccagtaaatccagatagcgctcaacatgcgcgtgcgcctgctcatcaccctgctcccacaacgcgataatctccggcgcctgcagcgattgatcataataatgttgatatagccacgcaaacccgcgcccggacagataattctcaatgcagcccatctggccgcatccacaacggcggagaggaaaatcaaaccccatcaacgttagcgcgtcaaccggcaaacgcatatggccaaactcgccggtgatatagctctgaccggtaatcggcttcccgtttagcaccaggccgccgccgccggtgccgaggataagccccataaccaaaggatattgcgtgaattcatcatcccaggcttcggacaaggcaaaacagttagcgtcattgtccagacgcacatcgcgatccagtcgggcgctgagatcggcgcgcaacggcttaccgctggctgccgggacattcgcggcgtacagcgtgccgtcttcagtttccggcataccgggtatgccaatccctaccgacccttttacgccaaatcgctggtcggcttccgcgaccagttcgcacacggcgtctaaaaaggcgctatagctggtatggggcgtgggaacccgtttttcccactgcagccgccgcgttgagtcaaatacgcctaacgcaatctttgttccgccaatgtcaaacccgtaatacatcgccgctccttgtttttatattccgcgattactggccgctcaatactcgcgcagggtcaatgttgctcgcccgccgcgccggataccagctcgccagtaagcttaacaacaacgccgtgaccagtacgtaaacaacgtccagccaatgtaattcggatggcaggaagtcgataaaatagatatcgccggacaaaaactgatgcccgatctccttttcaatcccattaataatggcggtaagctgaagcgaaacgacaacgccgatcgccacgccaatcaagctgcccagcaagcccgccagtagtccgtaccagacgaaaatggcacgaatcaaaccatctttcgcccccagcgttcttaataccgcaatgtcgccgcttttgtcttttaccgccatcactaaggtggaaacgatattaaaacaggccacgccgatcaccagaatcatcgccagatacataatggcgcgaatcatctggatatcgcgatacatatagccgtaggtgccgatccagctcttaatgtagacatagctgttagtcacttcacccgcatcacgcaccagtttgttcgcattaaacacgtcgtggactttaagcgcgataccggaaacgctggaccccatatccagatactgctgcgcatcctcaagcgggatcatggcgaagctgtgatcgagctggccgctcagttgcagaatcccgatgacatgcaaacgcacgcgtttgggctggagcagcttatggtcggcattcgcattggggatcatgatggacacccagtcgccctgtttcacgttcagcgcatcggcgacgcctttaccgataatgatctgctgctcgcccgctttgaaatgatcccaggcgtgattttgcacaaatgacggtaacgcgctaagctgctgctcttgcttaggatcgacgcctttaacctgaatggcgcgcaaattcgccccgctctctaccaggccggtaaaattgatatacggcgcggcggcggcaatgcccggcaccttctgcacttttgccagcgcttcacgccagttggtccacggctgattgaccgcttcaatctccccgtgtggaaccaccgccagaatacggttattcaactcgcgttcgaaaccgttcatcgcgcttaaaccgacaatcaacaccgccacgcccagcgcgataccgatggtagaaatgacggaaatgagcgaaaccataccgccgcgccgccgtccacggctgaaacgcaagccaattaacaatgataaaggcgacgccattactcagcccccatcaggctcagttccgctgtcaggcggccatcgcgcatctcaagctggcggctcatacgtttcgccagttgcaaatcgtgagtcaccaccagaaacgcggttccctgcagacgatttaactcgcccagaagctcaaaaatactgtcggcattacgcgcatccagattaccggtcggctcatccgccagtaccagacgcgggttattcaccaacgcgcgcgctatcgcgacacgctggcgctcaccgccggaaagttccgaaggtcgatgggttgcgcgatgctccagccctacagcatgcaacatttctcgcgcccgagcgtcaatctccgccggtttctttttgccaatcaataatggcatcgccacgttttccagcgccgtaaaatccggcaggagatgatgaaactgatagataaaccccagtttctggttacgtaattccgcttttgccgcagaagagagtttgctcatcggctggccgctaaaaatcacatcgccagaggtaggcgtatccagcccgcctaacagatgcagcaacgtacttttacccgaaccggaactgccgacgatcgccatcatttcgccttcgccgatactgaagctgacatcgtgcaacacgtcggtttgtacggtgccttcctgatagcgtttgcacaggttgtcgcattgcaacaggatcttattcataacgtaaagcctcagcgggttgagtggcggcagcgcgccaggaaggataaagcgtagaaagcagcgcgatggccattgccaccagcgcgataacgatcacctgtaacggctctatcgccacgggcaacgcagcgccatccagaaacgcgccgatgatcggcatcaggttattcagttggctggcaagcaatgcgcccagcgcggcgcccaacagcgcgccgataatcccggcgctggcgccctgcaccataaagaccatcataatttgtcgcggcgtcagcccttgagtttgtaaaatcgccacttcgccctgcttctccatgaccatcagacccaacgaagtaataatgttaaaagccgcgaccgccacgatgaggctcagcaacaatcccatcatgttcttttccatgcgcacagcctggaacaactcgcctttacgttcgcgccagtcctgccacttcgtgccttgcggcagcgtctgttggctgagagtatcgacttgcagcggttcatccagccacagacgccagccggtaatattgcctgccggatagcgcattaaacgcgacgcgtcctgaatattgaccagcatttcatagccatcgacctcgctattggcggcaaatgtgccaatcaccgtaaacagacgctggctgggcaggcgtcccattggcgtaaactggctggcagatggcaccattagccgaatctgatcgccgcggttgacccctaactgtccggcgagctgctcgccgaggatgacattatacttacccggctgtaattcgctttgcttcacattgaccagatacggcgttaacggatctttttgcgccggatcgatacccaacatcacgccaaccgcaacgctacgcgcgctttgcagtacgacatcgcccgtcgtcagcggcgcaatacggttaacgccttgcagattcaccgctttttccggcatctgattcgggttaagagaaccatgttcagcagagaggatggcctgaggcatcaaaccaagaatgttattttgcagttcgcgctcaaaaccgttcatcaccgacaataccgtgaccagcgccatcacccccagggtaatgccgatagtggaaagccaggaaacgaagcgaccgaagcgatctgctgcacgcccgcgcatgtaacgcaggccgatgaataaagcgacaggttgatacatgtaatccgtctggttgctgttagcaaagtcccgagtatataagcgaaagcggaatgcgtaaatgtctgaaccgtaagagttcgtcagcgttattctgaaaaaggccgacaaatcaagtcacttacatgttcatactttacctgttcggcgtgttatccggcggattcaatttgctaataaacaacgatcgcggataataaagaacattgcttatcagtcatatgcccctgaatacctgagtccttcatgctgtcctggcgcgcagccaaccatgaagcagcctgaagggtgacgcgtagagtgcggcgtaaaacaaaaagagatactgacaaccgttatgcctgaaaaacaacgttacacgctgccgacaaaagcgggcgatcagcgccagttgggcgaacttaccggtgccgcctgcgctacgctggtggcggagatagctgaacgccatgccggtccggtggtactcatagcgcctgacatgcaaaatgctctgcgattgcatgatgaaatccgccagtttaccgatcagatggtcatgaacctggcggactgggaaacgctaccgtatgacagcttctccccgcatcaggaaattatctcttcgcgcctgtccacgctctaccagttgccgtcaatgcagcgcggcgtcttgattgtaccggtaaacaccctgatgcagcgcgtttgtcagcatagctatctgcatggtcatgcgctggtgatgaaaaaaggccagcggctgtcccgcgacgctctgcgcgcgcagcttgacagcgccggttatcggcatgtcgatcaggtgatggagcatggcgaatacgcgacgcgcggcgcgctgttggatctctttccgatgggcagcgaacagccttatcgcctcgacttttttgatgatgaaattgacagcctgcgtctgtttgacgcggatacccagcgtacgctggaggaggttgaggccatcaatttgttgcccgcgcacgaatttcctaccgacaaagccgctattgagcttttccgtagccagtggcgcgatacctttgaggtaaaacgcgacgccgagcacatctatcagcaggttagcaaaggcactctgcccgccgggatcgaatactggcagccgctctttttcagcgaaccgttaccgccattatttagctatttccccgccaatactctggtggtgaataccggctcgctggaaaccagcgccgaacgctttcaggccgatacgctggcgcgttttgaaaatcgtggcgtcgatcctatgcgcccgcttttgccgccggaagccctctggctacgggtggatgggctcttttccgagcttaaacgctggcctcgcctccagcttaaaaccgaccatctgccggaaaaagccgccaataccaatctcggtttccagaaattaccggatttggctatccaggcacagcagaaagcgccgctggacgcgctgcgtaagttcctcgaatctttcagcggtccggtgattttttcggtggaaagcgaaggacgccgcgaagctctgggagagctcctggctcgcataaaaatcgcgccgaagcgaatattacgcctggacgaggcgcaggatgcgggacgctatctgatgattggcgccgcagaacatggctttatcgacacccaacgcaatctggcgctgatttgtgaaagcgatcttttgggtgagcgggtggcgcgtcgccgcctggattcccgccgcacgatcaacccggatacgttgattcgtaacctggcggagctccacgtcggtcaaccggtagtgcatctggagcacggcgtcggacgctatgccggcatgaccactctggaggctggcggcatcaagggtgaatatctgatgctcacttacgccaatgacgccaaactgtatgtgccggtctcctcattgcatctgattagccgctatgccggcggcgcggaagaaagtgcgccgctgcataaactgggcggcgacgcctggtcgcgcgcccggcagaaagcggcggaaaaagtgcgcgatgtcgcagcggaactgttggatatttatgcgcaacgagcggcaaaagagggttttgcctttaagcatgatcgtgagcagtatcagttattctgcgacagcttcccgtttgaaacgacgcccgatcaggcacaggcgattaacgccgtattgagcgatatgtgccaaccgctggcgatggacaggctggtgtgcggcgacgtcggcttcggcaaaaccgaagtggcgatgcgcgccgcgttcctggcggtggaaaaccataaacaggtggcggtactggtgccgactacgctgctggcgcagcaacactatgacaacttccgcgaccgtttcgccaactggccggtacgcattgagatgctgtcccgctttcgcagcgccaaagagcagacgcaaatcctggcggaagccgccgaaggtaagatcgatattctgatcggtacgcataaactgctacaaagcgatgtgaagctacgcgacctcggcctgctgattgtcgatgaagagcaccgtttcggcgtgcgccacaaagagcgaattaaggcgatgcgcgccgatgtcgatattctgacgctcacggcgacgccgatcccgcggacgctgaatatggcgatgagcggtatgcgcgatctctccattatcgccactccccctgcccgtcgtctggcggtaaaaacctttgtccgcgagtatgatagcctggtggtaagggaagcgattctgcgtgaaatcctgcgcggcggtcaggtttactatttgtacaatgacgtcgaaaatattcagaaagccgcagagcggctggcggaactggtgccggaagcgcgaatcgctataggccacgggcagatgcgcgaacgtgagctggaacgggtcatgaacgatttccaccatcaacgttttaacgtgctggtgtgtactaccattatcgaaacggggatcgacattcccaccgctaacacgatcatcattgaacgcgcggatcatttcggcctcgcgcagttgcaccagctgcgtggccgcgtagggcgctcgcaccaccaggcctacgcctggctgttgacgccacatcctaaggccatgaccgccgatgcgcaaaaacggctggaggcgattgcgtcgctggaggatttaggcgccgggtttgcgctggcgacccacgatctggagatccgcggcgcgggcgagctgcttggcgaagagcaaagcggctcaatggaaaccattggcttctcactctacatggaattgctggaaaacgccgttgatgcgctgaaagcaggccgcgaaccctcgctggaagatctcaccagtcagcaaacggaagtcgagctgcgaatgccgtcgttactgccggatgattttattccggatgttaatacccggctgtcattctataaacgcattgccagcgcgaagaacgaaaacgagctggaagagatcaaagtggaattgatcgaccgcttcggcctgctgcccgatccggcgcgtaatctgctggatatcgcccgcctgcgccaacaggcgcaaaagctcggcatccgaaaactggagggtaacgagaaaggtggaacgattgagttcgccgagaaaaaccacgttgaccccgcctggcttatcgggttactgcaaaaacagccgcagcatttccgtctggatggcccgacgcgcctcaagtttattcaggatttaagcgaacgtaaaacgcgtatagactgggtacgccagttcatgcagcaactggaagaaaacgctattgcataagcgtcaggccgggcgtcattactctgcgcccggcctaatctttacaaattctttgcacttccctgcagttccagacacagccaaccgccataattcttatttcctcttttataaaaataaccacataataatcatgggcttattataatgttcaacaatacgcgactctctcgctggtgggcgttgcttgcgcttaccgcgaccatcatgcttgcccttcccgcgcaggcgaatacgtggcctcttccgccccccggcagtcgactggtgggagaaaataaattccatgtcgttgaagacgacggcggctcgctggaggcgatcgccaaaaaatataacgtgggctttttagccctgttacaggccaaccccggcattgatccttacgtgccacgcgcaggcagcgtgctgacgattccgctgcaaacgctgctaccggacgcgccacgtgaaggtatcgtcattaacctcgctgaattacggctttactattatcaaccggggaaaaatacggtcacggtctaccctatcggcattggccaactgggcggcgataccctgacgccaacgatggtgacgaccatttcggataaacgcgccaatccaacctggacgccgaccaccaatattcgcgcccgttataaagcgcaaggcatcgatctccccgccgtggtgcctgccggtcccgataacccaatggggcatcacgcgattcgtttagcggcctacggcggcgtctatctgttacatggcacgaatgccggttttggcattggtatgcgcgtcagttccggctgtatccgtctgcgcgacggtgatatagagacattgttccgtcaagtcacgccgggaaccaaagtgaatattatcaatacgccgattaaagcctcggtggagccaggcggcgtgcgactggtggaagttcatcagtcgctgtaagcgtgaatagctgactgacaaaaaagcctcgcgatgcatcgcgaggctttctctttttattgtggcaatcgcagcggcattaatgagggttaatgcttacttatagattaccgccgtaccgtggagggtattcgggccggtaacagaggtaatacggaaagacttcgcccccatttcctgcgctttttgcgccagctgatcttccagcgagcccagattcgtgccgccattcgcggaaatggtgccgaacttctgttgaccttctggcgttgcctgaacttcaacggcggcgaagctggcgaatgagagcgaactcagtaccgcagcagcgatgaggttttttacgtttttcatagtgatgacctttagcagatgaatgggtgtcgcaagcattaacttaacgatcgataaattaatcatagatgtgatctacatcacacgtcaacctctttttataatgatcgttatataatttataaagatgttatttttcatgtgaatagaattgatttatttttctaatgaatactctggagccagaagtggtttgtttttataatagagagaccgctctttaaacaggtacaacggcatcatgacaacggataccacgagttgcgcgaagaaaagccgtggccgaccaaaagtgttcgacagggaagccgcgcttgataaggccatgactctcttctggcagcacggctatgaagcaacttcgcttgccgatctcgtagaggctaccggggcgaaagcgcctactctctatgcggaattcactaacaaagaaggattatttcgcgctgtcctggatcgctacatcactcgctttgcctcaaaacacgaagcccagctcttttgtgaagagaaaagcgtagaatcggcgctggaagattacttcacagaaattgccgcctgctttaccagtacagacacgccggctggctgctttatgattaatacgtccgccaccctggccgcctcctcgcgcgatatcgcccgcacggtaaaatcacgccacgccatgcaggaacagacgctcatccagtttctgcgccaacatcaggagcgcggtgaaattccggcgcactgtaacccgcaggcgctcgcggaatatataaactgtattttacagggaatgtcgatcagcgcccgtgaaggtgccaccttcgaacaactgatgcaaattacgcgtacgactctgcgcatctggcctgaactgctcaagtcctgaacgacgcggcttcggataaaaaaagcccctcagcctgagcgaatgaggggctaacttgcagagtacagcttttttatgctttgttattcagaaccagttgaccattgccgtcgaggggaatttgcgttccggggtctttatccatgcggattttgccctgctgatcgccaattttgtaggtcacgtcgtagccaagcatcttttcagatttgtcatacaccgtcttacagcgttgctgcgtggtagtgtaggtatcactctcctgcattgatccctggatttgattgccagcataaccgccgcccagcgccccgacgaccgtcgccacatctttaccacgaccgccgccaaattgatgtccaatcacgccgcctgctactgcgccaagcaccgagccggcaatacggttttcgtcctgaaccggtctacgatgcgtgaccgtgacattacggcactcctgacgcggcgtttttaccgtctctttaatcggtttagccgatatcacctgcgcatactgcggaccacgatcaaatacgttgagactggccactgccgccacacccagcgcagccgctacgccaatccctatacccgccaacattgatttattcacgggagttcctccttcgttgctattggtaacaattttgcaaccagtatgcgaacaaagccaatcggaatgaggatgaaaaatgcgggatgaggcggtaaagctgaaggattcggacaactccgaagcaagtgatggagaagcgctcaccggcgagcagccggtgaggcgcagaaaaattaatgcagtttcaggcgcggacgaatgacgcggttaatactgcccaccagcatcatcaggccggttttaaagtatccatgcagcgctatctggtgcatacggtatagcgagatatacacgaagcgggcgatacgtccttcaatcatcattgaaccgcgggtcaggttccccatcagactacccacggtagagaagttggacagagagaccagcgatccatgatctttatactggtaagctttcagcggcttgccattcatctgcgccagaatgttattcatcgcgcaggtagccatctgatgcgccgcctgagcgcgaggcggcacaaaacctccctccggacgtgcgcaggaagcgcagtcgccaatcgcataaatatcaggatcacgcgtggtttgcagcgtcggttccaccaccagttggttaatgcggttcgtttccagaccaccaatttctttcataaaatctggcgctttgatacccgccgcccacaccatcagatcggcctgaatatattcaccttctttcgtatgcagaccgccttcgtcggcgctggtgaccatagtttgcgtcagtacgcgaacgcccagtttggtcagttcattatgcgcggcgctggagatacgcggcggcaacgcaggcagaatacgctcgccagcctcaaccaacgtcacgttcaacgcgtcgttggtcagccccttataaccatagctatgcagctgttttaccgcattatgcagttcagccgacagctcaacccccgtcgcaccgccgccaacgatggcgatattgaccttaccgttcgcgcccaggttagccgaatacttgaggaacaggttcagcatctcctggtgaaaacggcgcgcctgatgcgggttatcgaggaagatacagtgctctttcacgcccggcgtgttgaaatcattagaggtgctgcccagcgccatcaccagcgtgtcatacgcgattttgcgctccggcaccagcagttcgcccttttcatcacgcaactcggcaatggtgatggtcttcgcttcgcgatcgatatccatcaccgaccccagctggaactggaaaccatgattacgcgcatgagccagatagctcagcgcatccacgccttcgtccagagagccagtcgccacttcgtgcagcaatggtttccacagatggctgtgatttctgtctaccagcgtgattttcgcttttttcttgcgccccagtttatggcctaactgcgtcgccatttccagcccgccagcgccgccgccgacaatcacgatcttttttaatggtgtagtcaacgtgacccccttaaatttattaaccaattgttaattaaaagttattagtatagcctttaattaacaacaagttacgttaatgagaataagcttctgatatgagaatagcatgaacggtgcattggtcataccaaaattgatgtgcatcaagttttcatgctgaaaagatagacagtttgcgagaattgagcataaaaaaaccagccgcaaggctggttatccggtcactgataacgccatattgccggatggcgttaccccagcgttttaaacgctttgatacgttgcaagtgcggcgaaatatttttgaatttgtgagtctgttcctcatcccacacaatttcataaaacgggtgaagcgcttgcgctgagcgttggctgtccagcgcttcgtcatgacgcgagaggatcaccagacaacgatcgcgatttttttcgcgaaagttggtcacgcactttgtagcgatgtccgcatattcttccgggcgatcgattttcccctccatgttttcataggggaacaggttcgggttaaaaaccacctgacggatatcgcacaaaaagccaatccgctccgcccagtaaccgcccagccctacgccacagattaaagggcgctcgtccacattcaactgcaacattttgtccacttctttcagcagatgctgcatatcgtgcttaggatgccgcgtactgtagcttaccagccgaacatccgggtcgataaattgtaattgcaacactttttcatggttacccggactatttgaatcaaaaccgtgtaaataaataatcatctggcaccctcacgaaaactcgagttaatgacctgctttttcttcctgccagcgttcatgtaactggttgagctgggcgctggctgttttccagcgtgctgagtccatgagctcccggcgtgaaaatgaacctttatgatacaaacgtgtaacacgttctgctttgatcggcgacagattatccagcacgctgactgcgcctttacgattattgcagaccagaatcatatcgcaacccgcatccagcgacgcctgagcgcgctcagcatagctgcccataatcgccgcgccctccatagacagatcgtcggagaaaatgacgccgtcaaagcctagctcctgacgcagcaccgttttcagccagtacggcgaaccgcttgccggacgcggatcgatagcgcggtagatcacgtgggcaggcataatcgcatccagtttattctcactaatcagcgcgcggaacaccgacatatctttgccacggatgtccgtttcaggacgtggatcgcacggcgtctctttgtgggagtccgccgtgaccgcgccgtggccggggaaatgcttaccggtcgttttcatcccggcgtcatgcatgccgtcaataaagcgtgttgccattgccaacgcttttgcgggatcggcatgataagaacgctcgccaattgccgcgctgatatgcccaacgtccagcactggcgcaaaactgatatcaatatccatcgcgatcatttcgctggccatcagccaccctgcctcctgcgccagtcgccccccctcttccagcccatgcagcgcaaaaaaagattgcgccgcgggcaggcgggtaaacccttcacggaaacgctgtacgcgcccgccttcctgatcgacggccaccaccagatggttacgcgatgccgcccgaatctggcgcactaattcgcgcagctgttccgggtcatggtaattacgcgtgaacagaataagcccgccaaccagcggatgcgccagtatctcgcgctcctccgcatccagctcacatccttcgacattcaacattactgggcccacactgctctccttatcctttcatacgtagctggcgccaggtttcatcggccagcctgataaattgttgctcgccggtttgtcgccagcggtattcgaaccaccctgcttttagcataatgacccaggggtgccataatcgtatctgtcgccatagctgccgggcgtcgattcgcgcgcgcgcggcataagcgtctgccagttgtcggtgctggcgttcatcctcaacccatactgccgccagctccaacgcaatatcgccgtcgccggcatactcccagtcaatcagtctcaacccggcggacgttaatactatattgtcgccatggacatccatatgcaaaggcgcgagccgcagcgggcgaggttcaccgtttttttgcaactgtttgagccgccgcaaccaaaacggcgtacgccttgccggatcgcaacacgaccagtactgcgccaatagtggcgatagcgcgatacgccagccaaaacgcggctgttgatgcaaatgatacagtaaggccgccagttcgtcggcatctggcagagcggaatttaccacaccatgcagatattctaccgccatccagcctggcgtataaaaaagcgctcgcggcgccagactggccggcaattgggataaggcgcggtgatgacgtaaaaaatgggctggtggagcgtcggggtcgtgatgacggcgcagcacgatacggtgagtatcgtgagcaataatacagctcccgccgcttagcccctgcgatgcggcgacggcgggacgatactggggaaaatagcgcgacaggatctcgtcgcgcgttaagggattattgttgttggaccgcacctttacctgaccagattatctcgccagtttgcaccagcattaactgcatctgtaatgcaggcgcgttaacgttaccggatgcgctggagtaaagtacatattgcgccccgacattgcgcgcaatgccaatagctttactgcgcgttcccagactatcctgcggagacaaccctaactgctgttttgccatcgcgagttgctgtacggagaccagcgtaaatttaccgttgttcgccagcgcattacgtaacgtttccgttgcctcgttcgcatttaacgacccattcgtccggttattcacgctgtcgacaagcaatacgcttctggccgtcacgccatcagcctgcaacattttgctgaccagcggttgcatcgcgccgttccagtcatagtggcgcaccttaggcgctggctggcccgtttgatcttcatgttcgatcggccccggttgttgtggaatcgttggcacagacggcacaacaggaggctgcggcggctgcgcgggttgttctggcgctggttttacctcttcaactggcgcaggttgacgttgcgccatacacccggagagaaatatcgccagcgcagcaatggcggcgtagcgatgcatttttgtcatcaaaattcactcctcacaaataaagataaagcctgaccttatgcgcccccagataattggcgctgccaaatagcgttaccgacgaacgcgcgggtatggttacgctacgcggcgcctccagcggatgcatctccagcccccgcgcgtcataccagtaaaaccgataatgaacggttatgggctcttgcctttcgttatagacgcgggaagaagctgatggctggatatcagacgccgtcagttcaggcggctctgcggtgacacccgccgccagaaccgcggactccatcaccagcgactgcgcgtcgcttaccggaatttcaggatgtgaccggcagccggtaagcagcagcaagcccagagaaaccgcgatgcatcctttgatcatacttacaagcctttatgcgccagcatcgggcctagcgggcggccgcccagtaggtgcatatggatatgataaacctcctggcccccatgacggttggtattcatgattaaacgatacccatcttcggcaatgccttcttgttcagcgattttcgccgccacggtgatcatccgacctaacgcctgttcatgttccgccgtcacgtcattgacggttgggatcaggatattgggaataatcaagatatgcgtcggcgcctgcggtgaaatatcacgaaaggcggtgaccagctcatcctgataaacgatatccgaagggatttcacgacgaataattttgctgaatatagtttcttctgccacgacgttttcctttttcataatagcccttgcagcgcacatgctacgccgagccatactgcgagtatagagtatgagcgagttaccgacgctctttcaactttaacccacgatttattaagcgaaaaatgactacatgctggacttaccgccatatccccctgccatgacgcctttgtacgcttaaaaaatatttctagtttccctggttataccgttttacacatttaatacaaatgcgtatatttctcatttgcatttttatacgcattaactagcaaagaatgaaaaggttcaacgtcatacgtcctgaacttaccccaataacaagcaaggattttcagatgtctttcattcaataccgccgggacaaacaccttccgtccaccgccgcaccgtcgctgttagctatgggtatggcgatggcatttatgcctgccgccttcgcggctgaggataccgttattgtcgaaggcgcgacgaccgctgacgccataaaccgtgaagaacaggattacagcgtgaaaacgaccgcagcgggcaccaaaatgccgatgactcagcgcgatatcccgcagtcggtcagtattgtcagccaacagcgtatggaagaccagcagttgcaaaccctgggcgaggtgatgaccaatacgctggggatcagcggaagccaggctgactccgatcgcatcagctattactcgcgcgggtttgaaattgacaactatatggttgacggtattccaacgtattttgagtcccgctggaatctgggcgatgcgctaacggataccgcgctgtatgagcgcgtggaggtggttcgcggcgcgaatgggctgatgaccggaaccggcaatccttctgcctcaattaatatgatccgtaaacacgccaccagtcgggagttcaaaggtaacgtctccacagaatacggtagctggaataagcagcgttacgtcatggatctgcaaagtccgctcaccgcagacggtaatgtccgtgggcgcatcgtggcgggttatcagaataatgattcctggctggaccgctataacagtgagaaagcgttcttttccggaattatcgatgccgatctgggtgcaactaccaacctttcagccggttatgaatatcaaaaaattgatgtcaacagcccgacctggggcggtctgccgcgctggaataccgatggcagcaaaaatagctatgaccgcgcgcgtagtaccgccccggactgggcttataacaataaagagataaataaattcttcgtcacgcttaagcagcgttttgccgaaagctggcaggcgaccctgaatgcgacccatactgagggtcaaattcgacagtaaaatgatgtatatcgatgctttagtggataaagagacaggtacgctggtgagtccttatggcgcaagctaccccgtggtcggcggtactggctggaacagcggcaagcgcaaagtagatgccatagatctctttgctgatggcgcttatgagctgtttggccgtcagcacaatatgatgtttggcggcagttatagtaaacagaataaccgctattttagcgcctgggcgaacgtctttccggacgacattggcaacttcggcgcctttaacggtaatttcccccaaacccactgggcgccacaaaatctggcgcaggacgataccacgcatatgaaatcgctgtatgccgctacgtgcatttcgctggccgacccgctgcatctgattcttggcgctcgttataccaactggcgtgttgatacactgacctacagcatggagaaaaaccataccacgccgtatgccgggctgatttatgatatcaacgacaactggtccgcttatgccagttatacctctatctttcagccgcagaataaacgcgacaaagcgggtcaatatctggctccgattaccggtaataactatgaagcgggcctgaagtccgactggatgaacagccgcctcaccactacgttgtccgtgttccgcattgagcaggataatgtcgctcaagcaaccactattcccatccctggcagtaatggggaatttgcctggaagtctactgacggaacggtgagcaaaggcgtcgaatttgaagtgaacggcgcaattaccgataactggcagatgactttcggggctacccggtatgttgccgaggacaatgaaggtaacgccgtgaaccctaatctcccgcgcaccagcgtgaagttattcacccgctatcgtctgccggcgataccggagctgacggtcggcggcggcgtgaactggcagaatcgggtttacaaagataccacgacgccatacggcaccttccgcgccgaacagggcagctatgcgctggtcgatctgtttacccgctatcaggtgacgaaaaatttctccgtacagggaaacatcaacaacctgttcgataaaacctacgacaccaatattgatagttccattgtttacggcgcgccgcgtaacgtcagcctcaccgccaactatcagttctgacagactgtcggagagcgtcatgtaaagcgccattaaaaaaggcagccgaatggctgccttaatactccccaacatcattactgcttagctgttacggatgtactcatccatttccgttttcaggttatcggatttcgtaccgaaaatagcctgaacgccggaacccgcgacgacaacgcctgccgcgcccagtttcttcaggccagcctgatccactttcgctacatcggctacgctcacgcgcagacgcgtgatacaggcatccaggttagtgatgttctctttaccgccaaacgccgcaatcaaagccggcgccatttcgctggtagcgcccgcttttgcgtcatcagtagagtcttcacggcccggcgttttcagatccagcgctttgatcagcacgcggaacacggtgtagtacacaatcgcataaccggcgccaacaatcgggaacagccacaatttgctgctgttaccggacagcacgataaagtcgatcagaccgtgggagaacgacgtaccgtcacgcatccccagcaggatacagatcgggaatgccagacctgccagaatcgcgtgaataatgtacaggatcggcgccacgaacatgaaggagaactcgataggctcggtaatacccgtcaaaaacgaggtcagcgcggcggaaatcatgataccgcccacttttgcgcggttttccggtttagcagagtgccagatagcaatggccgcagccggcagaccgtacattttgaacaggaagccgccagacaacatacccgccgtcgggtcgcccgccatatagcgcggaatgtcgccgtggaatacctgacccgctgcgttggtgtattcgccgatctgcatctggaaaggaacgttccagatatgatgcagaccaaacggcaccaggcaacgctcgataaaaccgtaaatgccaaacgcgacaaccgggttctgataagccgcccactgcgagaacgcctggatagccgtaccgactggcggccatacgaaagacagcaccacaccggtaaaaatagcggccagacccgaaatgatcggcacgaagcgtttgcccgcaaagaagcccagatactcaggcagtttgatacggtagaagcggttaaacatatacgctgcgatcgcaccggagataatccccccgagaacacccgtatcagcaaggtgtttagcggcgatctcttcagcaggtaaatgcagaaccagcggcgcaaccacagccatggttttcaccatgatgccatacgctactaccgccgccagagccgaaacgccgtcgttgttggtgaagcccaacgccacgccgatagcgaaaatcagcggcatattggcaaaaacagatccgcccgcttctgccataacgtgcgatacaacggctggcagccagctgaagttagcggaaccgacacccagcaggatacctgcgatagggagtacggataccggcagcatcagcgatttaccggccttttgcaggttagtaaatgcattcttaaacataattgagagtgctcctgagtatttgtgcttttctacgttctcacgcattggcgaggggggagaaccccgccgtggacaggacatctaagtgcccttttatttattacacagagtaaaataaatacgtctgattttgtttgacggctatcacgtttcagcgccagatagcctaaaaagtatcacattctgccaaaatgagttttcgaatgtttccataagctcgctcaccgccccttttgtggcggtgaactttacgcgctttgcttattaattacgagctttaaaaaaactcgtttaacggattgatgacaggcgagacgcgtcaatatggaacaggcgagcaaagttatcggtggtgatctgcgccagttcttcaacggcaacccctttcaataccgccatatattctgcgacgtcgcgtaccatcgcaggctggttctctttaccgcgatgcggcaccggcgccagataaggagaatcggtctcgactaataaccgatccagcggcacatagcgcgccgcatcacgcaactgttcagcgttacggaacgttacgatgccggaaaaagagatataaaaccccagatccagcaatttgccggccgtttctctgtcttctgtaaaacagtgtagtacgccgccgcaatccgtcactttttcttcgcgcaggatagccagcgtatcggcacgcgcgtcgcgagtatggacaatcaccggtttatgcaattcgcggccaatctggatatgatgaataaaagacgcctgctggcggattttggtctcaggcgtgtaaaagtaatcaagcccggtctcgcccatcgccaccacatcgtcttctgcagcaaggaggcgcagttcttctacgtcatatacttcatcctgatttaacggatgcacgccgcaggaaaagaccacattatcgcgcttgcccaccagctcgcgcatatggcgataccccggcaacgtcgtcgccaccgctaaacagaacttcacatcgcgcgcggcggctttcgccagcacatcgtccacgtccttatgcaaagattgataatccagaccatcaagatggcagtgtgagtcgactaaaaacataatgtctctctcaaagatgaggaacaggcaacaaggtgcctggttgcaggtaatgctcgatgcggagaatgagatcggttaataccagttcgcgatttaatccggtcacatgaagtaattgatcacgacaatggcaaacatcgttcaggattgcctgaatacgcgccggggatagcggccccgccagcgcggcaacaaccgcgtccgcatcaacgtttgtcaggtacgacgcgccgtgctgacgtttcagcgcgtctaccagcagcgtcgccagccagtgcaggcgcgccggggcttgctcatgattgagcgccgttaataacgcataccagtcgcccgtatgtaaactgtccatcaacgcctgacacagcgcctcacgctgcgcccaacgttcagactgcaacagcgccagcgcggcgccgggcgaccccgcgttcaggcgtagcgccgtgagcaatgcttcttgtgacgccgtcacttctcgcgacagccatgacatcgcatacgattcggacggcggcgccagatgatgcagccgacaacggctgcgtaatgtcgccaacagacgagcaggctccgggctggcaaggaaaaaccaggtttgctccggcggctcttccagcgttttgagcaacgcattggcggcggcgtcggttaatagcgccgcatccgcaatccacaccaccttcgcaccacccagacgggagtgctcgtacaatttctcgctgacctcgcgtaccgcatctacaccaaggctgcttttgcctttatccggcgtcagcgtgtaatagtccggatgcgtgccagcctgcataagctgacagccacggcaatgcccacagcttttgtggccctcaggctgctggcataacagataacggctcagcgcatagcacagcgcctcgtcgcccatgccaggtaaggcctgaatcagtagcgcatggtgcccacgtcccgcctggtaactttctaccagtttttcataggcgggccgtaaccatggataccatttcatgccgcttgctcctgcacccacttcgtcaccgtggcgcgaatgtcgcgcatgacggcatccagcggctgggtcgcgtcaatggtgcggatacgcgagtcttgcgccgccagttccagatagcgcgcgcgagtccggttaaagaaatcaaaagattcctgctcaatgcgatccaaatcgccgcgcgctctggcgcgttttagcccgacttccggcgtgacatccagatacagcgtcaggtcaggacgaaaatcgcccagcacggcatcgcgtagtgtcgccagcatggtttgatcaatgccgcgccctcccccctgatacgcctgggtcgagagatcgtggcgatcgccgatcacccatacgccttgcgccagcgcgggtttgattaccgtttcgacgagctgtacgcgagcggcataaaacatcagcacttccgctttatcggtaatcacttcgtcgcctaccgatcggatatccagcaccagacttcttagtttttcggcaagctgcgtaccgcccggctcacgggtaaaaatcatgttacgaatacccagttgctcaagggtctccaccaccacgtcgcgcgcagtggtttttccggcgccttccaggccctcgatgacgatataattactgcccatttttttccttaagcactttctcctgcactgaccgattatggctggcaagattggtgttaaatgtgtgaccgcctttaccgtcggccacaaaatagagatacggcgttttcgccggatgcgccgccgcctgcaatgacgcttcgctgggcgatgcaatcggtcctggcggcagcccggttatggtatacgtgttataagccgtcggcttttccagatccgcacgcgacaagttaccattataactcgtccccatcccgtaaatcacggtgggatcggtctgaaggcgcataccgattctcaggcgattaataaagactgaggccacctgatcgcgttcgctggcgacagccgtctctttttcaataatcgaggccattgtcaccagttggttctgatctttataaggcagcccctcggcccgacctttccagacagtatcgacagctttcaccatcttttggtgcgctcgcttgagaatagcgacatcgctggtgttggcggtatacatccaggtatcaggccagaaccacccttctacccattccgggtgcgcaagctttaatgcctgagcgacagtggcgtagtcatcatccggcaatgtatggcgaatatacggcgcctctcgtaactgtttcaggtaatcgctaaggcgcatcccttccacaaaccgcaacgggaattgcgcttctttgccgctctccagcaactcaagcatctcccgtacggtcatcccgggcgtaaaacggtaagttcccgctttaaagtgcgataactcaggctccacgcgcagcagccactgaaatacccggggacgattaatgattttttcatcataaagctggtcaccaagcgccagccgacccgttcccgccttgagcgtaaagatagtctcgtttttaataagtaacgtgctgttcgccagatggcgaactttccacatccccacgcccgtggcaatacccagcacaaccaacagcagaaggaaaacgcctgacaattttttcataactaattcggatgctcacaaaatggggctaaaaattgaaacagtgttcgcgaagaatacgacgtcccgtgataggcgcgtatgggaataatcggcattagcgcgttgcagatgataatctcatccgcctgcctgactgcctcctctctcgcctgtacttcaagaacctggaaaggagattgcgccagttggcgtaaacaaaattgtcgcataatgccgttcaccccggcctgatccagacgcggcgtaaaaacaatgtcgcctgtacgccagaacaaattagccgcacagcattccgtaacccatccctcgctgtcaagaaccagcgcctcatcggcgtccgtctgctcaagatgagagcgaatcaacacctgttcgaggcggttcagatgttttaatccggcaagataaggattgcgcccaagcggtatgggactaagggtaagagtgatgccttgcttacgccactgagaataataagcgggataagcagaaacggagaggattcgggtagctgcctgacaattcatggcgctgtatccccggccgccgctaccacggctaatgatcactttcaacacgcctgaatcatgccctgtggccaacattgtcatctcttgccgaagggtcgaccaatggctaaaagcgatccgtaatttttcacaggcaacctgcaagcgctgaagatgcgcttccagatggcaaatgttgccatcaacaatacgtgcggtcgtaaaactgccatcgccgaactgcgtcgcccggtcgcttacagcaagttgatcctgcgcatggccattaattaaaaacatagtggctccttatccgtcgcctgctagtgtggcaggatgaataacgcagaacaagaggtgatatgcctgataaaaaaggcccgacaagcggacctttttattaatgtctgtctctggcttaacttagatctttttaaagatcaaggaaccgttagttccgccaaagccaaaggagttacacagcgcgtactccagatcgctgacctggcgcgcttcatgcggcacgaagtccagatcgcaaccttcatccgggttatccagattaatggttggcggaatggcctgatcgcgtagcgccagaatagagaaaatagactctactgcgcctgcggcgcccaacagatggccggtcatcgatttggtcgagctcaccatcactcggcttgcagcatcgccaaagactgacttaaccgcctgcgtctcagctttgtcgccggcaggcgtcgacgtgccgtgcgcgttgacgtagccaatctgagcaggctcaatcgcggcatcacgcaacgcgttaaccatcgccagcgcagcgcctgcgccattttccggcggcgacgtcatatggtaagcatcgctgctcataccaaagccgacgatttcagcatagattttcgcactacgcgcttttgcatgttcgtactcttcaagcaccaacataccggcaccgtcgcccagtacaaaaccatcgcgttctttatcccacggacggctcgccgcctgtgggttatcgttgcgggtcgacagcgcgcgcgctgcgccaaaaccacctacgcccagcggcgtactggctttttctgcgccacctgccaccatcgcgtccgcatcaccataggcgatgatacgcgcggcatggccgatgttatgcacgcctgaagtacaggcagtcgcaatagagatgcttggcccacgcaggccatacatgatagtcagatggcctgctaccatgttaacaatcgtcgacgggacaaagaacgggctaatcttacgcggtccgccttttaccagcgaactgtggttttcttcgatcagaccgagaccaccgataccggagccgatagcggcgccaatacggcttgcgttctcttccgtcacttcaaggccagaatcctgcatggcctgtacgccagcgacaattccatattgaatgaaggcatccatcttgcgctgttctttgcgcgagataatgtcatcacagttaaaatcctttactaagccagcaaatttcgttgcataggcgctagtatcgaaatggtcgatcaggctgatgccactctgaccggcaaggagagctttccaggtagactctacggtattgccgacaggagacaacatgccaagtccggtcacaactacacgacgcttagacacggttgtcctccagggagggaaaatgattctagtgggacaaaaagataaaactcaggcggtcgaacgaccgcctggagatgttcacttacgcctggtggccgttgatgtaatcaatggcagcctgaacggtggtgattttctcagcttcttcgtccggaatctcagtatcaaactcttcttccagagccattaccagctcaacggtgtcaagagaatctgcgcccaggtcttcaacgaaagaagcattgttggttacttcttcctgcttaacgcccagctgttcgccgataattttcttaacgcgttcttcgatagtgctcatactcttaaatttcctatcaaaactcgctttcgcgatggttttcgtagtgtataaaatgttgaaaaatttgcaactaaatcccggcaggtcttaccacgattttacgttattttgcggcctttcgccctaataacgcaaatatttttcaatcgtgattaaaccatgtacattccgccgttgacgtgcagagtctcaccagtgatgtaactcgcttcgtcagaggctaaaaatgcaaccgcactggcgatttcctgagcgccgccgaggcgacccgcaggcacctgcgccaggatacccgcacgctgatcgtcagacagcgcacgcgtcatgtccgtttcaataaaacccggagccacaacattgacagtaataccacgggacgcaacttcacgcgccagtgatttactgaaaccgatcaggcccgctttcgccgcagcgtagtttgcctgacctgcatttcccatggtaccaaccacagaaccaatagtgataatgcgaccacaacgctttttcatcatagcgcgcattaccgcttttgacaggcggaaaacggatgataaattggtttcgataatatcgttccactcatcatctttcattcgcatcaacagattatcacgagtgataccggcattattaaccaggatatccacttcaccaaattctgcgcgaatattttccagaacagattcaatagatgcaggatcggtcacattcaacatcaaacctttcccgttagcacctaaatagtcgctaatgttcttcgcaccattttcactggtcgcagtcccgataactttcgcgccgcgggcaacgagagtctctgcaattgcgcggcctatgccacggcttgcaccagtcaccagcgcaatctttccttcaaagctcatggttttcctcttttattgcgtaagtgccgcagacagcgccgccggctcgttcagcgccgacgctgtcagggtgtcgacaatacgtttcgtcagaccagtgaggactttacctggacccacttcataaagatgttcaacgccctgcgccgcgataaattccacgctcttcgtccactgtaccggattgtacaactggcgaaccagcgcatcgcggatagcggcggcatcggtttcacatttcacgtcaacgttgtttactaccggcaccgttggcgcgctaaaggtaattttggctaattcaaccgccagcttatctgccgttggtttcatcagcgcgcagtgcgacggcacgctcaccggcagcggcagcgcgcgtttcgcgccagcggctttacaggctgcgcccgcgcgttctaccgcctctttatgcccggcgataaccacctgtcccggcgagttaaagttaaccggcgaaacaacctgcccttcggcagattcttcacaggctttagcaatagaggcatcatccagaccgatgatcgcagacatgccgccagtaccttccggaaccgcttcctgcatgaatttaccgcgcatttccaccagacgaacggcatcagcaaagttgatgacgccagcgcaaaccagcgcggaatattcgcccaggctgtgacctgccattaacgcaggcattttaccgccctgctgctgccaaacgcgccaaagcgcgacggaagcggttaatagcgccggctgcgtctgccaagttttattcagttcttccgctggaccttgctgggtgagcgcccacagatcatatcccagagccgcagaagcttcagcaaacgtttcttctacgatagggtaatttgccgccatctcggccaacatcccaacgctctgagaaccctgaccggggaacacaaatgcaaattgcgtcatgtttaaatccttatactagaaacgaatcagcgcggagccccaggtgaatccacccccgaaggcttcaagcaataccagctgaccggctttaattcgcccgtcacgcacggcttcatccagcgcgcacggcacagaagccgcggaggtattgccgtgcctgtccagcgtgacgacgacattgtccatcgacatgccgagttttttcgctgtcgcgctaatgatacgcaggttagcctgatgcggcaccagccaatcgagttctgagcgatccaggttattagccgccagcgtctcatcgacaatatgcgccagttcagtgaccgccactttaaagacttcattacccgccatcgtcaggtaaatcgggttatccggatttacacgatcggcattcggcagggtcagtaattcaccgtaacggccatcggcatgaagatgagtggagataatacccggttcttcagaagcgctcagtacggccgcgcctgcgccatcgccgaaaataatgatcgtaccgcgatcgccaggatcgcaagtgcgggctaatacatcggaaccgaccaccagcgcgtgtttaaccacgccggatttaacgtactggtcggcgatacttaacgcgtaggtgaaacctgcgcacgctgccgcgacatcaaacgccgggcaacctttaataccgagcatactttgaatctgacatgccgcgcttggaaatgcatgcgttgctgatgtggtcgctaccacaatcaagccaatttggtctttatcgatccccgccatctcaatcgcgcgattcgcagcggtaaagcccatcgtcgcgacagtttcattcggcgcggcgatatggcgttcacgaatacctgtacgagtgacaatccactcgtcagaggtctcaaccattttttccaaatcggcgttagtccgcacttgttcgggcagatagctgccagtaccaataatcttcgtatacatgtacgctcagtcacttttcggttatataccgttacctgtaaacgtctggcacgctggcggcgccggggagacagcgatattatctgtgcgcccgcaggtttacgcctttgccatcgtccagcggttcaaatccggctgggtatacagattccaggcgagcggcaattcgctgaggaacttgtcgctgcaccgcctgcactgcctgttcaatcgcgactgcaaatgctcgctgattggccgcaccatgactttttatcaccgtgccgcgcaatcctaacagacaggcgccattatactggtcggggttgaggtgactgaatcgcctcgtcaggcttttttgtaaccaacgttttaataacagcagccaccacgaccgttttttcccctcgccctgtgatttcagcagtgaaaggaacattctgacaaccccctccatcgttttaagcgtgacattgcctgtaaagccgtcacacaccagtacatcggtttttcccgtcagtaactcattcgcctcaaggtagccgatgtaattgatggttgggactgtttttaacattaaagaggcttcgcgaatactgtcgaggcctttggtttcttcttccccgatattgagtagcgccacgcggggatttttgatcccgacgacctcttccgccaaaacggcgcccatcacggcaaactgcaccagcatggtactgtcgcaatcgacgttggcccccaaatcaagcactaccgttttgcccttttgctggtgcggtaataccgtcaccaacgccggacgctcaatcccctcaagaggcttgagcaataatttcgccagccccatcagcgccccggtattaccggcgctaacgcaagcttcggctcggccttctttcacaagctccaaggccacacgcatggatgtcccgcgactggcgcggatcgcctgcgaaggccgggcatcactggcaataactgactgtgcagggataatctgcagacgcgaacgttgttcaaagtcagctttggcaagtaatggcgtgataatatcgggattcccgactaaaagaagagtgagctgcgaattagcgttcagtgcctgcaatgctgcaggcaccgtcacggaaggaccaaaatcgccccccatgacatctaacgccagggttagacgtgtcaaggtatcgtcgctgcctggttcggtgttctccgcttacgcggagaaatcctcactaagctttatcacgcttgtactcttcggcttttacaccacaggcacgcctgtgatgcaaaaggcatcgagtatcgcgcgattacttagcgatgaccttacggccgcggtagtaaccgtcggcagtgatgtggtgacgcaggtgtttttcaccagaagttttgtctacagacaggctggtgactgcggtcagagcgtcatgggaacgacgcatgccacgtttggaacgggttggtttattctgttgtacggccatggaccttactcctcaattacggtttatccctgcgtccgcggggaagacctattacttacgctttaagctggctaatacggcaaatgggtttggcttttgcgcttcatcaggcagttcgccaaagaccatgtccgcctcggacacttcacagtgttcagaatcatgcaccggaactaccggcaaggcgaggatgatttcatcttcaaccgtcgccagcagatcgatttcgccgaattcgtttacctcaatcggctcatacgcttccggcagtgcttcagcctgctcgtcggaacggacagggctaaaacaatacgttgtgtgaacctgatgggtaaacggtttcccgcaacgctggcattcgagcgacaccgtaacgaccgcatcgccagtcaaaacggcgagacgctggttatcgatagcgaacgacatggagcattccacatcactgtccacactgactacagattcggcaacgcgctcaacctgatcgggggtatagataccctggtaatcaaggcgtttttgagcggtacgaaccggatcaagagtcaggggtaattttaccttttgcatagggcgcgcatattaacttcgtaacgtcatatagtcaaagaaaaaggcagcctgcggttgccttttgccaataattcgcacacattgcgggttacagacttattttcgctcaagacgagtcagtatgacaggcttgaagaccgaagagcatagtttaagatggctctcatcattacgctatatctgagggaaaaaatatgccccgtctcatccttgcgtctacctctccctggcgtcgcgcgctgctggaaaagctgacgattcctttcgaatgcgccgcgccggatgttgatgaaacccccatgccgggcgaagcgccgcgtcagttggtgctgcggctggcgcaggctaaggcgcaatcgctcgccgcgcgtttcccgaatcatttgattattggctccgaccaaatttgtgttctggacggcgaaatcaccggcaaaccgctgacggaagaaaaagcgcgtcagcaattagccaaagccagcggaagtattgtgacgttttataccggactggcactgtataactccgcctccgggcacttacaaaccgaagtggagccttttgacgttcactttcgccatttaagcgaagcggaaatagacgactatgtccgtaaagagcatccgctgcactgcgcgggaagttttaaaagcgaaggtttaggcattgcattatttgagcgcttagagggccgcgatccgaacacgctgatcggcttgccgcttattgccctgtgccagatgctgcgacgggaagagatgaacccgctgaatgcctgattaatctgcctgatggcgacgcgatgcgtcttatcaggcctacggtgcatcacacgattgtaggcctgataagcaacgcgcatcaggctttactacgtaatacctcaaggcagcgcttcaattgcttatccattggcgcttcaatgcgcatgacatcgcccgttcccggatgcgtgaacttcagcgccgcggcgtgcagaaagagacgtttaagaccggttcccgcttcggtaagctgttgatcaaactcacggtcgccgtagcgatcgtcgaacgcaatagggtgaccggcatattgggtatgtacgcgaatctgatgcgtacggcccgtgaccgggctacagcgcaccagcgtggcgaaggcataacgctcttccaccttgaagcgcgtttctgaaggtttgccttcctggctcacgcggacaatgcgttcgccgctttgcagaatgttctttaataatggcgcctgtacggttttaacgtgtgattgccactggccgcgcaccagcgccagataatctttctgcattcccttttcgcgcagttgctcatgcagcgaacgcagcgcggagcgttttttcgccaccaacagcacgccggaagtatcgcggtcaagacgatgcaccagttccaggaatcgcgcttccggacgcaacgcccgcagcccttcgatgacgccgaaacttaacccgctcccaccgtgtacggcggtgccggaaggcttattcagcaccagaatatggtcgtcttcatacaaaatgacgtccgccaacgccgccactttttgcaaatgcggcgacacagcctcttcttcgcgctcagcaacgcgaaccggcggaatgcggacttcatcgcccgattccagtttgtattccggtttaatgcgttttttgttcacccgcacctcgcctttacgcaagatgcgataaatcatactttttggtacccctttcagttgggtgcgcaaaaagttatcaatgcgttgccccgcttcgtcagcggcgatagcaacaatttttacggatggcgtttctgttttcatggggggcgattctaaatagcctgtgagattcgcgccacacatttttctatgcttatagagacgtctacgccagtggatgaacatttttcactgcggttttgctggttattaaagcgattggctcgcgctggtgaaaaaactgtgagtaagcgggtgataaatggtaaaagtcatcttgctataacaaggttagcagtggaataatgatgcggtttccgcaccgaaacttgttaaaacaaaaagtttagcggaataacccattttgtctgaccgatcatcaacgcagcaatggcgtaagacgtattgatttttcagacagttagcgggctgcgggttgcagtccttaccggtagataggatcttctctggagagtaatgcccaggctgcttccctgataattgcgctgtgtttccgtatgaaatacaggcaaccgacactctgcgcctctttgagctgacgataaccgtgaggttggcgacgcgaaatagtcacgaggccatcggttcatgcccggtaaggcgtcaccatgcccgcagcttagtcgtcaacgtaagaataatgagtaagttacgatgaaaagaatgttaatcaacgcgactcagcaggaagagttgcgcgtcgcccttgtagatgggcagcgtctgtacgatctggatatagaaagccccggacacgagcagaaaaaagcgaacatctataaaggcaaaattacccgtattgaaccgagcctggaagcggcttttgttgattacggcgcagaacgccacggtttcctcccgttaaaagaaattgcccgcgaatatttccccgctaactacagcgctcatggtcgcccgaacatcaaagacgtgttacgcgaaggccaggaagtcattgttcaaatcgataaagaagagcgcggcaacaaaggcgcggcgttaaccacctttatcagtctggcgggcagctacctggtactgatgccgaataacccgcgcgcgggtggtatctcccgtcgcattgaaggcgacgatcgtaccgagttaaaagaagcgttggccagcctggaacttcctgaagggatggggcttatcgtacgtaccgcgggcgtgggtaaatccgccgaagcgttgcagtgggatttaagcttccgcctgaaacactgggaagccattcagaaagccgctgaaagccgtcccgcgccgttcctgatccatcaggaaagcaacgtcatcgtacgcgcgtttcgcgactatctgcgtcaggatatcggtgaaatcctaatcgacaatccaaaagtgatggaaatggcgcgtcagcatatcgccgcgttgggccgcccggattttagcagcaaaattaagctatacaccggtgaaatcccgttgttcagccattaccagatcgaatcgcagatcgagtctgcgttccagcgtgaagtgcgcctgccctccggcggctccatcgtcattgacagcaccgaagcgttaaccgctatcgatatcaactccgcccgcgcaactcgcggcggcgatatcgaagaaaccgcgttcaacaccaatctcgaagcggccgatgagattgcccgccagttgcgtctgcgcgacctgggcggcctgatcgttatcgactttatcgatatgacgccggtacgtcaccagcgcgcggtagaaaaccgcctgcgtgaagcggtgcgtcaggaccgggcgcgtattcagattagccatatttcccgcttcggcctgctcgaaatgtcgcgtcagcgcctgagcccgtcgctgggcgaatccagccatcacgtgtgtccgcgctgtagcggtaccggcaccgtgcgcgataacgaatctctgtcgctgtccattctgcgcctgattgaagaagaagcgctgaaagagaatacgcaggaagtccatgccattgttccggtgccgatcgcctcttatctgcttaacgaaaaacggacggcagttaacgctattgagacgcgtcaggatggcgtccgctgtgtcatcgtcccgaacgatcagatggaaacgccgcactattccgtgctacgcgtacgcaaaggggaagaaacgccgaccctgagctacatgctgccgaagctgcacgaagaagcgatggcgctgccttctgaagaagagtacgccgagcgtaaacgcccggaacagcctgcgctggcgacattcgctatgccagatgtgcctccggcgccgacgcctgtcgaaccggcggttagcgttgccacggcgaaaaaggataatgttgccgccgagcagcctgcccagccgggtctgtttagccgcttccttaacgcgctgaaacaactgttcagcggtgaagaaacgaaaaccgtcgaaacagccgcgccgaaagcggaagaaaaagcggagcgtcagcaggatcgtcgcaagccacgacagaacaaccgtcgcgatcgtaacgaacgccgcgacacccgtgataaccgtgccagacgtgacggcggcgagagccgcgacgataatcgtcgtaaccgtcgccaggcgcagcagcaaaatgcggaagcgcgcgatacccgccagcaggaaacggcggaaaaagtgaaaaccggcgatgagcagcaacagacgccgcgtcgcgaacgcagccgccgccgcaatgatgacaaacgccaggcgcagcaggaagtaaaagcgcttaaccgcgaagaacagcctgtccaggagaccgagcaggaagaacgcgttcagcaggttcagccgcgccgtaagcaacgtcagcttaatcagaaagtccgctttaccaacagcacagtggttgaaacggttgacacgccggtcgtcgtcgacgaaccacgcccggttgaaaacgttgaacagcccgttccagcgccgcgtaccgagctggcgaaagttgatttacctgtcgttgccgatatcgcgccggagcaggatgatagcgtagaacctcgcgataataccggtatgccgcgtcgctcccgccgttctccgcgccacctgcgcgtaagcggtcagcgtcgccgtcgctatcgtgacgagcgctacccgacacaatcgccgatgccgttaaccgtcgcctgcgcgtcgccagaaatggcgtccggtaaagtctggatccgctacccgattgtccgtcctcaggaaacgcaggttgttgaagagcagcgtgaagcagatctggcgctgccacaaccggttgtcgctgaaccgcaggttatcgctgcgaccgtagcgctcgaaccacaagcgtcggtacaggcggtagaaaacgttgccgttgagccgcagaccgtcgccgaaccacaggcgccggaagtcgtcaaggtcgagacaacgcatccggaagtgattgccgcgccggttgatgaacagccgcaactgattgccgaaagcgatacgccggaagcgcaagaggttattgctgacgccgaaccggtagcagaaaccgccgacgcgtccattacggtggctgaaaacgtagctgatgttgtcgttgtcgagccagaagaagagacaaaagcggaagcggctgttgtggagcacacggcagaagaaaccgttatcgcaccggcccaggtggtggaaaagccgcaggacgttgtctgcgttgacgatcataaccacgccagcgcgccgatgacgcgtgcgccagcgccggaatatgtgccggaaaccccgcaccatagcgactggcagcgcccttccttccactttgaaggtaaaggcgcagcaggcggacacagcgccacacgtcacgccagcgccccggcgacacgcccacagccggtagaatgatgtaaatgctgatacaaagccgaccgccaggtcggcttttttttatgcctcttacagggcgatgcctcaccccatggcgtcttttagtcactccaggcgtttatgagatcgggcgggataatacgtacggatggcgtcgctacgggcgcgacaatatgaccactaactcaataacgactaaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggataagggatcgataattgctcacccattttatcctcttcaagctggtgctttatgtagtcctgtatcttcgccgtgttcttacccactgtatcgacatagtaccctctgcaccagaactccctgttcctgtatttgaattttagatccccaaactgctcgtaaagcatcagactacttttacccttcagatatcccatgaagctcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaatgcccgcgccggggtggatggcgcgggcagacaaaacatatccagtttcgtgatatgtttcaaaaagaggcgttaccggttcaactggaaaagcgacattccctgcatgtcggtaaacgttttataggacgcctgtaatgccgcctgttgcatgacgtaggaggaaatgaccgagttccagtccacatctaccaggttgctcatctgtagcttctgtcccagcgcacggtcgcttcccagtgaatccagcgtactgagttcgctcagttgcgttcccagttccgcacgaacggtcaggacgttattaagcgaattttttaagccgcgattggttttatcaatggcggcagcggctttttctttttccacgtcattgccttccaccggggtcttgagcgcggcaattgccgtatcgagcatgacaaacagattcttttcggagtccgagccatccggttccggcaccgcattgctggtgatgctattaaaaatttgcgctcccgtatggccaattaccatcgtgcgtgcggaatccacctgctgggtaacacttttctcgccgccatgataaccacctgtcgcctggtcgaatggcgccgcttccgttttatacccggcaaagatatagcgaccattgccgtcagtgctgtttgccaggttcatcagctgatcgcggatcccctgtaaatccgtcgccagcgacgcgcggtcatcgtcgcttaacgtgccgtttccggcatagacgattttttcctgcgcggtttgaatcgccgtcgtcacctgactgagtacgctttcttccagcgacactttttgggtggcaaacgtacgcgccagggcgtactggctattctgcgcctgcgcctgaaagagtactaccgcctgcgacgcggcgatcggatcgtcagatgggttggtaacgcgcttaccggtagacatctgctcgcccagcttcatccattcggcctgagaattagtgatgccgctcatattttgttcgtacatcatctgggtactgatacgcatgtcatccttctcctttagcgaatattcaataacgcatcaaacagcgcattcgcggtctgcaatacttgcgcattcgccagataatactgctgataacgctgcaaattgccgtactcttcgtcgaggttaacgccggaaaccgactgttgctgtttataaagctgtttaaccacattcgcctgcgtggtgctgctggttttcagcgttgacgttttgttacccacatcgctgaccaacgtggcgtaagcatcgttaaaggttttgttgccgcccactacattgctgttttgtaagtccagcaatgcctgaccattgcggttatcgctgtcgccggtatccacatcaggatcgagttttgactcagacgccatcgcaatctcggcttcatttgtcactttaacgttcatgtcgacgatagcattgctgaccggcttgagaagaaaactgtcgtttttctgtgcgccagtccctaccgtcactttcagaccgtcaatctccagttttccgtcagcatcttttgttgccgtgaaggtggtgttatccgcagtgcgagtaacctgccagtctgtaccgtcaaaaacaatcttataatccgtcgcctgaaccttcgtgctgtcgaccaccttagcggttagcgataccgttttatcggcattattactgttgctatataccaccggcgagccaatgctaaagaagtctttccctttattgccgtcggcgtcataacctttggtatgctgcgcgttaaacgcatcggcaaacgccaacgccaactggcccagcgtattacgagtctgatccagatcctgagaacggaacgtcagtagcccgccgagcgaaccggtgttcagcaacttttccggaatttcgatgttaccggcggcctcatcgacataagcgacagtcgttcgcgtcgggtcggcgctggagggaaccgccgccaactgacgcgccgtcgacccctgcaccagcgtatagccattggccatcgtcaggttataggtgccgccgtcctgtacactcacctcgacgccaacgatcttgttaagctcgctaaccaactgatcacgttgatcgagcaggtcgttcggcgatgcgcccgcgcctacgcccgtcatacgggagatttgatcgttcaggttagctatctgcttcgcgtaattgttgatttgcgccacgctggagccaatcgcgatattgacctgtttatcctgatcgcgcagatactgatcggtggttttgaactggtttaccagcccttccgctttaccaatcagcgcctgacgcgccgcaggatcttccgcattactgactaacgtttgcaggctggtaaaaaaactctgcagcgagccagacagtgagctggatttatcggccagcaggttgtcgattttcgacatttgttcatagcgcgtggttaagccgctgctctggttttgcgcgccgcgtagctgattagtgataaacgcatcatattcgcgctgtacgcctgaaacgtaaacgccattacctatccagccgccagcccctaacgtactgtttgcctgcgccagaatagttgtctgccgggtataacccgcaacgttataattgttgatgttattactgaccgtatttaacgcggcctgcgcggcgttaagtccgctcatggcgtgattaatcaagctggacatgatggttccttttaatccttcaatactcgttgttatcggcagcgactacgtggacttgagcaatttaaaagagattgtcgagattcgcgctgtaggttttgctgaccttttcactcatcgctttcaactgctgaatcatgctggccaatttacgcgcgtaattcgggtcagtggcgtatccggcgttttgcagagccactgcgccctgctctgccgtggcggcagtggtcacggcagcgtagcgtgggttacgcgttaacagcgcgacataatccgataacgcctccagatacgagctatagacgcggaatttcgctttcacttttttcgcttcgccattttcgtattcagtggtggtgatttccgtcaccggccctttccaactggcggtcgctttcacgccaaatacgttatagctgggttcgccattctcccgcaggatttgccgctgcccccagccggactccagcgccgcctgcgccagaatcagatgatgcggcaccccgctttgttcgctggccagcctcgccgggagcgaaagccgggccagaaagtctttactgtcgccggagagcggcgcatcgctgctgtccggcgttttcggtatggctttgcgcaccagttgggtcagcgcctgattttgatagctgtttaccgtctccagggagaatttaagcggtacttgcggcgcatcatctgcaggcatcgtctgcccgcccgtcatctgtttaaccatcatatccgccagccccaatcccttaccggcggtcatctgctgggcgatctgctggtcatacatgctggtatacagacgcgtctgatcgctgctgaataaaccatctttgggtaaagcctcgcgcatacttttcagcatcatctgcacaaacatcccttccacctgacgggccacaggacggatattcgccgccgggtcctggcccgctttcgctttcagttcgttcagagattgcgcatcccaggccgcgctggccagcaatttaccgtctccgatcatcagatgatttccagtttggcgcgtagacagcccgcgctctgcatggactgcaaaatcgacatcagatccatcggcgtcgcgccaagcgcattcagcgcgcgcactacgctgttcagattggcgctggaacgcacgctctgtagcgatccgccgctctgacgcaaatctatctgagtctgtggcgtcaccacggtctgcccgccgccaaatggcgtattcggctggttgacgttgagttggcgattgactgtcactgacaaattgccctgcgccacagcgcagctatccagcgtgacttcccgattcatgaccaccgaaccggtacgcgagttgatcacgacttttgcatcctgcggcgtcacgttgacttccatattttgaatgtccgccagaaaacgcacctgcgagctgttgccgctgggcacgcgtacctgtaccgttcgcgcatcaagcgcagtggcgctgccgtaaccgcgggcgcggttgatggcgtcggtaatttgctgcgccatcgtaaaatcttcgtcgttcaattgcagattaatggtgttgccagcgccgaactgagtcggcaactcgcgttcgataatcgcgccattagtgatgcgcccgccattaagctggttaacctgcacgctactgccgcctgcggaagcgcccgcgccgccgaccagaatattgccctgcgccagagcatacacctggctgtccaccccttttaacggcgtcattaataacgtcccgccacgcagacttttagcgttccccattgaggaaacgacgacatcgatcgtttgtccctgtcgcgcaaaaggcggatacgacgccgtcaccatcaccgccgccacgtttttcaactgcatattggtgccggtggggaccgtaatccccagttgtgacagcatgttattcagcgtctgggtggtaaatggcgtctgggtcgtctggtcgcccgtaccgtccagcccgaccaccagcccgtagccgatcagcgagttttcccgtactccctggacactggtcagatcccggatacgctcggcgtgcgccagagtggcaaccagtgccagaacgattcctgcaagagctttaaacacatacacctcgcttacatcggcgacaaattaaggaagaaacgttgcagccagcccatattttgcgcttcgttaatatagccgttcccgacatattcaatccgcgcatccgccacctgtgtcgagggaacagagttgctaccgctgatggtgcgtggatttaccacgccggagaagcggatgaattccgttccctgattaatcgcgatctgtttttcccccacgacgtgtaaattgccattggccagaacctgatcgacggtcacggtcagcgtgccgctaaaggtattgctggcattcgcgccgcctttaccattaaaagagttgccgccggaggcctccatatccgcgcgggaattaccgaataatccctgcagataacgcggtaccgtatcaaaaccaaagctggttttgccgtcgcggctggcatttgccgacgagcttttactggcgctgacgttttcctgtaacacaatcgtgagcgtatcgccgatattacgcggtcgacgatcttcaaaaagcggctgatagccataattaatcggctgcgcagactgaaatatggagccattcgccaccggtaccgggccaggtatcggctgcgccgtggtcgccccctgcacgagcggtttagcgggtatccaggcgcatcctgtcagcgtcgcgaccatcagggccataactgggtaagcgtgaagcgcgtatttttgcattaccttcatcttcaaaatcagggagccggtggcgtatcccccaccggcggccccttagagttgcgtcagtttctgcagcatctgatcggtcgtcgatactgctttactgttaatttcataggcgcgttgaacctgaatcatgttcaccagctcttccgccacgttaacgttcgacgtttcgacatacccttgatacaacaaccccgcgccgttgagccccggcgtgctttcgttcggcgcgccggacgattgcgtttcgatatagaggttctcgccgatgctttccagaccggtgtcgttcataaaggtggtcaggttaagctgcccgacctgaaccggcgcggcctgcccttgctgggtaacgctgaccacgccgtcgcggccaatcgtgatgcttaacgcgttggccggaatggtgattgccggctgcacctgaaaaccgcccgccgtcaccagttgaccattctgatccacctggaaagagccgtcgcgggtataggcagacgtaccgtccggcagcatgacctggaaaaagccctgccctttaatcgccacatctttactgttgttggtctgcgacaggttcccctgactgtgcaggcgctccgtggcgaccggacgcacgccggtaccgatttgcagcccggaaggcagcgtcgtctgctcggacgactgcgcgcccggctggcggatggtctgatacaacagatcttcaaataccgcgcgctgacgcttaaaaccattggtgctgacgtttgccaggttattggcaatcacatccatattggtttgctgcgcgtccagaccggttttggcgatccataatgaactgatcataaaatgtcctgtattaactcatcgacagcagttggttagctcgcccttcgttctcatctacgctggtgataaccttcatctgcatttcaaaacgacgtgcgttggcgatcatgtcggtcatggcttcaaccggcttgacgttactgccctccagcacgcccgacataatgcgaattgacgggtcggcggccagtaccgccccgcgttcagcctgtgcctcggcggtaaggcggaataaaccgtcatcgctccgctgcacctcattgccttccgctttgaccagcttcagccgcccaacgggcgccaccgtgtttggcgggtcgccgggattgagcgcggagatcgtgccgtctgccgcaatggtgatttccgacccttccggaacggtaatcgggccgccttcgccgataaccggatgtccctgaatggttaactgcccggtcgggcccacctggatattcccgttacgggtatatccttcagcgccatccgccgcttgcaccaccagccagccgtcctgctgtaacgcaacatccagcgggcgggaagtgtagtccaactgaccctgggtcatatccgcccccggcgtcgacgccgtaaccaacgtgcgcgtcgctaaagagaggccatcaacgggcaccgcgcgtagcgcgttaagctgcgcgcgaaagcccggcgttgaggcattagccaggttgctggccgttaccgcctgctggttaagcgtctggctggccgcccccatggcggtataaattgcgtgatccattaagctatcccgtcaggcgcttagcgcaggttaaccagcgtattgaggatctggtcctgggttttgatggtctgcgcattcgactggtagttacgctgcgcgacgatcatattcaccagctctttactcaaatccacgttagaggcttccagcgcgccgttcgtcagcttaccgaagttgccggaaccggcagtccccagcagcgctaccccggaggcctgcgtcgccgcccagacgttatcgccctgggatgccagaccttcgttgttggcgaagttagccagcacaatctgccccagcacctgctcctgctcgttggagtagttgccaaccacggtgccatcattgttaatctggtagctcaccaggtcgccaggcttatagccgttttgattggtggcgacgatgttattagccccggtgttctgctgcatggagttaaggaagctgagggagaaggtggccgctgtcgcgccattaatcgtaccggtggtgatgttcaccgtaccgccagactccagaatcccgttttcattgaatttcagcgtagtggacgccgttgttggcgcagtggctgcaggatcgctgctgtcatgggtgtacacagcccattcattatctttggttttcacaaaatagacgttcatgtcatgggcattaccctggctgtcataaacggtgacggtgccttttttgttatacgaatccgcatcactcacgctaaagggcgttttagacggtacagggtccgttgagttcaggttgatctgcattgacgcggtggtggtcgatttcgccgccatcagcgtgttcggaatggtgatcggcgcaggattcgccccctgctgaatggtcggcggcgtaccggtggccggatagccggtcaactgcatcccctgcatattgaccaggttacggttctcgtccagtttgaactggccgttgcggctatagaacacggaaccgttgctgtctaccaggcggaaaaaaccgttctggctaatcgcgacatccagcccgcgcccggtgttcgttgtcgtaccgtcggtaaaatcctgggtaatccccgccacttttacgcccaaccccactttggaaccggcgaacatatcggcaaatgatgccgtaccggacttaaagccataggtggcggagttggcgatgttattaccgataacatcaaggttggtggccgcagcgttcaggccgctaaccgcttgagaaaaagacatgactgactcctgataagtgtaagggcttagattatttgccgaacttcgtcgagtgtggtggtgccgtaggtacccagatccaacaggttgccgttactgcccttcgtcacgccctgtaccagagcgaattgcagcggctgcgccaccagttgcgtcccgccattgctggcggtaatcgcaatgttgtaagaaccattcggtaccgttgttccgtccgtttgcttaccatcccaggtaaaggtgtgtaccccggctcgcaactcaccgatctccagcgtccgtaccacccggccatctttatcggtaatggttgccgtcactttgtccgcaggctgttgcaattccacgccaaacggcgtcgtggacgtcacggccccttcttccgcgcctttacccgccagaattgtggtgccaggcaccataacgccatgtccaatcagcgtggtcgcctgtagggactgactattatcgatttgcccggaaatagcccccagcgtcgtattcagtttttcaatgccgctcacggtactgatttgcgccaactgtgtcgttaactcattattttgtaatgggttagtcgggtcctggttcttcaattgcgcgaccagtaaggtcaggaaactgctttgcagatcggcagcgttgcttccggtcatcgacccgctgccggtcgtcgttttgacgcccgtgttggtcgggtcattcatatttacggcaatagacatacgcgcctcctttactggcctaatgtcagcgttttaagcatcatgctttttacggtattcaggacttcgatatttgcctgatagctgcgcgaggctgacatcgtgttgaccatttcgccgaccacatcgacgttgggcattttgacgtaaccattagcgtccgccagcggattgcctggctcataaaccagcttttccggtgcctgactttcaatcacgctggcgacctttaccccgccagtggcttgacccggcgcggcgtccacctgaaaaaccacctgtttggcgcgataaggctgtccgtccgggccggtgacgctatccgcattcgcaaggttactggccgcaacgttcaaccgcttggactgtgcggcaagcgccgatccggcaatatcaaaaatgtttaacagcgccacgaattagtttcctccctgtagcacattcatcatgcctttgagttggctacccagaacggtaagccccatctgatatttgagactgttatccgcaaactgcgtacgttccctgtccatatctacggtgttaccatccaaagaaggctgatcgggtacgcggtaaagcagatccactgcgggagaagagaccgcctgggcgggaatatggcgagaagaagtcaacgacaacgcgacgccgccggtttcttcccgtccgcgcaccatcactttttttaactcactggcaaaatcaatatcgcgcgcctgataccccggcgtatcggcattggcgatattcgccgctaatatttcctgacgttgcgcgcgcagatttagcgcttcctgctgaaatcgtaaggcggcatcgagcctgtcgagcatatctcctccgcaaatggcaaaattcagccgacagcttaaatgccttcacgcgcgcgttatcgccggaataaacgcaaaatgcgtcgctatttattgcgttgatgcttgcttcacacgggtagaatcctgtcatgacatcaaccagggggaagtaccatgcaaacgttaaaacgaggattcgccgtggcggctttgctgttcagccccctgacaatggcgcaggacatcaacgcccagctgaccacgtggttttcccagcgtctggctggcttcagcgacgaggtggttgtcacgctccgttcaccgcccaatctgctaccgagctgcgagcagccagccttcagcatgacgggcagcgcgaagctgtggggcaacgtcaatgtggtggcgcgctgcgccaatgaaaaacgttatttgcaggtgaatgtgcaagcgaccggcaattatgtcgccgtagccgcgcccgtcgcgcgcggcggaaaattgacgccggccaacgtcacgctaaaacgtggcagactggatcagttaccgccgcggacggtactggatatccgtcagattcaggatgccgtcagtttgcgcgatctcgctcccgggcagccggtacagcttacgatgatacgtcaggcctggcgtgtcaaagcgggtcaacgagtacaggtcatcgccaatggcgaggggtttagcgtcaatgcggaaggtcaggcgatgaataatgccgccgtcgcgcaaaatgcgcgcgtgcgcatgacatcgggtcaaatcgtgagtggaaccgtcgattctgatgggaatattcttattaacctataattgtgtaaagattttgtcgcggctgccgatgagatattcaaccatgatggtagctggccgctacaacgtaaccctcgatgaggataaataaatgagcattgaccgtacctcacctttgaaacccgttagcactgtccagacgcgcgaaaccagcgacacgccggtacaaaaaacgcgtcaggaaaaaacgtccgccgcgacgagcgccagcgtaacgttaagcgacgcgcaagcgaagcttatgcagccaggcgtcagcgacattaatatggaacgcgtcgaagcattaaaaacggctatccgtaacggtgagttaaaaatggatacgggaaaaatagcagactcgctcattcgcgaggcgcagagctacttacagaataaataagcgtatgactcgtttgtcagaaatacttgaccagatgaccaccgtcctgaatgacctgaagacggtgatggacgccgagcaacaacagctttccgtaggccagattaacggcagccagctacagcgtattacagaagaaaaaagctcgttgctggcgacgctggattatctggaacaacagcgccgtctggagcagaacgcgcagcgtagcgcaaacgatgacattgcagagcgctggcaggcgattaccgaaaaaacgcagcatctgcgcgacctcaaccagcacaacggctggctgctggaagggcaaatcgagcgtaatcaacaggcgctggaggtgctgaaacctcaccaggagccgaccttgtacggggctgacggtcagacttccgtctctcaccgcggcggtaaaaaaatatctatctaatcattgccggatggcgacgttgcgcctttccggcctgaatgccttgtaggcctgatagcacagcgctatcaggcactgaatttacgccgtccggcgaacaaactctttcactttaaagcccagcacggcaagcgcggcgaaataggccgcgatacccgcgatcactaccgccatcaaacgcagcaaacgccatagcatcgacccttgcgaccactccggcataatatgcaacacgccgaacaacacggcggccattaccagtacggaaatgatcagacgcatcaggaaccacatccaccccggttgtggcgtaaagatattctgtttgcgcagttgccagtacagcagcgacgcattgagacatgccgccagaccaatagagagcgacagcccggcgtgtttcagcggtccaataaacgccaggttcattaactgcgtcatgattaacgtcacgatggcgattttcaccggcgttttaatatcctggcgagaatagaagcccggggccagcacttttacgacgatcaagccaatcagccccaccgaataggcgattaacgcccgctgcgtcatcgccgcatcaaaggcggtgaatttaccgtactgaaacagcgagaccgtcagcggcttcgccagaatgcctagcgctaccgcgctcggcaacgccagtaaaaagcacaaacgcagcccccagtccatcaggcggcagtactcatcatgattgccgctggcaaagcttttcgacaatgacggcaacaggatggtccccaacgccacgcccagcacgccggacgggaactccatcaaccgatcggcatagtacaaccatgagaccgagccggaggccagaaacgaggcgaaaatggtattgatgataagggagatctgactgacggaaacgcccaaaatcgccggccccatctgtttgaccacccgcatcgccccggtgtcgtgaaagttaatgcgcggcagcaccagcataccgatctttttcaaatacggaagttgatacaccagttgcagcacgccgccgacggtgactgcccaggctaacgccagcaccggcggattaaagtatggcgcggcgaataatgcaaaaccgatcatactgatattaagaaatgtcggcgcaaaagcgggaatagagaagcgattccaggtgttgagaatggcgccaaccagtgaagccagcgagatcagcagaatatagggaaacgtaatccgcagcagttgcgtcgtcagcgcaaatttatccgcagtatcggcaaaacccggcgcggttaccataatcacccacggggcggccagcataccggccaccgtcacgacggccaatgccagcgtcaacaggccggaaacgtaagcgacaaagatccgcgtcgcttcttcaccctgcttgctcttatattccgccaggataggcacaaaggcctgagaaaaagcgccttcggcaaagatccggcgtagtagattgggaagtttaaacgccacaaaaaaggcgtcggtcgccatccctgcgccaaaaattctggcgacaatcgcatcacgggcaaagcccaacacgcgtgaaaacatagtcatcgagctgacggcagccagcgatttcaataaattcatttcttttgtattccagaccctggcgtaaaactcctgcatggctgatccatcgaccggataacgcaacttctgccgtatccggctgtatcactgcgcctgacggcgacgtcaaaacgtcttatcaggccttacagactccccacggtttgccattattcactgtgaaaagaggtattatgtagagtgggcatatatacccgccatacttcgagctgcatgtgcgttagcttttctgcaactcgaattattgagggtatagtacctggattacgatgaattactaccgccagatgttacagaggattattcgctgatggcgtcccgccacagcgcctccacgacgcgctgggccaaaatcgcctgctcccccgccgtttccggaaccgtctgattttgtacgcagtcaatgaaatgccgcgcgcatccgacaaaaccacgctgctcaagcgttgtttgccaacccggaatgggtttgatgagaataccctgcccgcgctcttcgcgccattcacgcatatccgtcacgtcatacagcccgccatcggtgacggcctggaccgattcacgctgacttccggcgcgccggtgcatactggtggtaatttgtaatttgtcggcggaaaaatgatgttccgcatagcacatttcgccggactcgctggtgagcaacgtgccgctggcaaggcgcgcctcgccgcccgccagccacagaacggtatccacgacatgcagatagtcatcgagcaaagtaaaacgtaagtcatgcggcccgatgctatcggtacgatgtttatccatacgcagtgacgccgcagtgccgaggcgcgtcttcagttcgcggtacagcggcgcgaaacggcgattaaagccaaccatcagcgtcaattttttttgcgccgccagcgccaccagccgttcggcatcacgtagattttccgccagcggtttatccacgcagacatggacgccagcgttgagaagttcgctgaccacggcataatggcttgcggtactggagtggacgaagaccgcatcgcagccggacgctaaattcgccagcgaatccacatacggtatgcgccagctttcgcaaatacgtaaggctttatcccgcgaaggagaccaggcgccctgtaacgtccatccggcggtgttggttaataccggcagccaggccttctgcgcaataccacctaacacgacaatgccaatccgtaatgttctcacattactctcccaggtgagctaacaaagaatccagccgctgctttaactccgccacttcgctttccagcgcttcgacgcgcgactgaagatcgcccgacgcactttccggcgcagacgtctggagagacagttcatcgacgtcgccgcaaaaaaggtgcatatagcggctttcgcgcttacccggttcacgcgccagacggacgacatacgggccgtcctcacgactggcaagccgttccagcgtggattcaacttccgccatatcgctgaattcatgcatccgcgacgcccggctacgcaactcgccgggcgtttgcgcgccgcgcagcagcaacgtagtgacgagcgccacttccgccgcgctaagtttcagatcgccaaattcggaattacagaagcgctgttcatatttggtgacgcggttgccaaacccgctgaccgtacgcaaaaagtggcgtttcaccaggttatcgagctgttcttgtacctcttgttccgtcaggttcatcaccggttcacggttggttttctgattacaggctgtcaccaccccgttgacggaaagcggatactgttccggcgttgtcacctgcttttccagcagacagccaatcactcgcgcttcagtggcggttaattcatatttcatcgttttctccctttgcctctcattccgtaagccgctcaacgccccggcgtccataacggcgtggttaacgccgtcaggacatggtcgcgccattgtccatcaatcaacaggtaatctttcgcatagccttctttttcaaagccaagccgcgccagcaacgcgccgctacgtttgttgtgcggcatatagttcgccatgatacggtggatatgctgagtgcgctgcatatagcgaatcgcagcggttaaggcttcaaacatcagcccttgcccctgccactcttgcgcaatggaatagcccagataacaggcatgaaaagaaccgcgcaccacattggaaaaattcgccacgccgataatttctttttcttccggatcaagtagcgcgaaatagaaggcggagccctgtttgtgaaattcaccgatcattcccagacgcgcctgccatcctgaaggataacaatgactttcatcacggaccggttcccagggttttaaaaaatgacgattttccgcgtaataatcggccagacgccaggcatcacgctcatgcactaaacgtaccaccagacgatcggtggttaagcgcacttttggcacgttactgcgatagccaaacattctatacctactccttcctgtaacgtcttcagcacgccagtaacattactatacctgcgcaaccaggccctgtgaaaagcgcaaatcgtcattttttgaattgctgccacattttgatgaaaactctcgattaaaaaggacttttgataaaaaaatattgtcccgctaacggtaggaaaaaacgaaacgccgccgcagaatagaagacgctcatcttttatttcccgggaggggaaatgtcgcgcgtctcgcaggcgaggaacctgggtaaatattttcttctcatcgataacatgttagtggtgctgggttttttcgtcgtcttcccgctcatctctattcgctttgtcgatcaaatggggtgggctgccgtaatggtagggatcgcgctcggcctgcgtcagtttattcaacaaggtctgggcatttttggcggcgccatcgccgatcgctttggcgcgaaaccgatgattgtcaccggtatgctgatgcgcgccgcaggctttgccaccatgggtatcgcgcatgagccctggctcttgtggttttcctgctttctttccggtctcggcggtacgcttttcgacccgccgcgttcagcgctggtggtcaaattaattcgtccggagcaacggggccgcttcttctctctgttgatgatgcaggacagcgcgggcgcggtgattggcgcgctgctgggaagctggttgctacaatacgattttcgcctggtctgcgcgacgggcgctattttgttcatattatgcgcccttttcaacgcatggctgcttccggcctggaagctatcaacggccagaacgccggtgcgtgaaggaatgcgccgcgtcatgagcaataaaaggtttgtcacctacgtgctgacgctggcgggctactatatgctggcggtacaggtcatgttaatgctgccgattatggtaaacgatatcgccggttcgcctgctgccgtgaaatggatgtacgctattgaggcgtgtctctcgctgacgttgctctacccgattgcccgctggagcgaaaagcgttttcggctggagcatcggctgatggccggtttgctcgtcatgtcgctgagcatgctccccatcgggatggtgggcaatttacagcagctttttacgcttatttgcgctttctacatcggctcggttatcgccgaaccggcgcgcgaaacgctcagcgcgtcgcccgcggacgcgagggcgcggggaagctatatgggctttagccgtctgggattagccattggcggcgcgattagttatatcggcggcggctggttgtttgatatgggtaaagcgcttgcgcagcctgaactaccgtggatgatgctcggtattatcggctttatcacctttttggctttaggctggcaatttagtcataagcgcacgccgcgccggatgctggaacccggcgcctgatttgatacctgtcgctatctcctccatactggtcaggaaccgacagtcaaatggaggagaaacgtgaagctttatatttacgatcattgccctttctgcgttaaagcccgcatgattttcggcctgaagaacatccccgttgaacttaacgtgttacaaaatgacgacgaggcgacgcccacccggatgattggtcaaaagatggtgcccatcctgcaaaaagatgatagtcgctaccttcctgaaagtatggatattgtacattatgtcgacaacctcgacggcaaaccgctgttaaccgggaaacgtaatccagccattgaagagtggttgcgcaaagttaacggttacgttaatcagctactgctgccgcgatttgcaaaatccgctttcgatgaattttctacccctgcggcgcgccagtattttatccgcaaaaaagaggcctcatctggcagttttgacaaccatcttgcgcactctgccggactgattaaaaagatcggcgatgatttacgtttgctggataaactcatcgtacagcctaacgccgttaacggcgaattatcggaagatgatattcatctgtttccgcttctgcgtaatctgacgctggtcgccggtattcactggccgacaaaagtcgcggactatcgcgataatatggctaagcagacgcaaattaatttactctcctcaatggctatctaacgcccgccaggcggcaaccctttcttgccgcctttttcagctttttttagtggcgccatgtccgctggcgcgacatgctgctttgtgtcaagattagggcacaggcaacatgctaaggaacgccatgaaaaagttttttttgccgctgcgctggtagttagcggcctgttagtgggttgtaatcaacttacgcaatacaccattagcgaacaagaaatcaatcaagcgcttgaaaaacggaataatttctcaaaagatattggtctgcctggcattgccgacgcgcatatcgtattgactaaccttgccagccagattggtcgggaagagcctaataaagtcacccttactggcgatgccaggctggatatgaattccctgtttggcagtcaaaaagcgacgatgaaactcaagctaaaagccctgccggtctttgataaagaaaaaggcgccatctatcttcaggagatggaagtagtagacgccaccgtgacgccggagaaaatgcaatcagtgctacaaacgctcctgccctatttaaatcagtctttacgtagctactttaaccagcggcccgcttacgtgttgcgtgaggacagtagtaaaggcgaagcgttagcgaagaaactcgcgaaaggcattgaagttaaacctggtgaaatcgttattcctttcaccaattgatttcggagggcgcgctcgcgccctttttttacgtgcaaacgaaaacgtttccgcttatcctttgtttccggcaaaaagactattcctcagccggagcttattaatgactgcaccatcccaggttttaaagatccgccgcccggacgactggcacgttcaccttcgcgatggcgacatgttaaaaacggtcgtaccctataccagcgaaatttatggtcgcgctatcgtgatgccgaacctggcgtcccccattacgaccgttgatgcagcgatcgcctaccgccagcgtattctcgatgcggtgcccgccgggcatgatttcacgccgttaatgacctgctatttaacggattcgctcgatgccgatgaactggagcgtggtttccatgaaggcgtgtttactgcggccaagctttacccggccaatgccaccactaactccagtcatggcgtaacgtcagtcgacgctatcatgccggtactggagcggatggaaaaactcggaatgccattgctggtccacggtgaggtgacccatgcggatgttgatatcttcgatcgcgaagcgcgttttatcgacaccgtaatggaaccgctacgccagcgtctgaccgcgcttaaagtggtctttgaacacatcacaaccaaagatgccgcgcagtatgtacgtgacggcagctacaacctggcggcgaccattacgcctcaacatttaatgtttaaccgtaatgatatgctggttggcggcattcgtcctcacctgtactgtctgccgattctgaaacgcaatattcaccagcaggcgttacgcgacctggtcgccagtggttttacgcgcgccttcctggggacggattcagcgccgcattcacgtcatcgtaaagagacccgttgcggctgcgccggttgtttcaacgccccctccgctcttggcagttatgccgccgtgtttgaggaaatgaacgcgctggcgcactttgaagcgttctgttcactgaatggcccgcaattctatggcctgccggtgaatacggggtgggtggaactggttcgcgatgaacaacagataccggaaaatatcgcgctggctgatgattcgctggtgccttttttagcgggtgaaacagtacgctggtcagtaaaaaaataaaaaatgcgcttacctgttgctatatattggatttaactgtatatatatccagtatattcaacagggggccattatgcgtattgaagtcactatagccaaaacgtcacctctgcctgccggtgcgattggtgcgctggcgggcgaactctcccgccgtattagccatcattttcctgagaatttgggtaacgtcaccgtgcgttacgctaccgccaacaacttgtccgtcattggcgcgtcaaaagaggataaagaacgcattagcgagattctccaggagacctgggagagcgctgatgactggttcatcaatgaataaaaaatgatatgcagtgatgtatgtttgccgggtcgccccggcttttttatttgcgcaactgatgaatatttcgcctgaccgtcaaaataattgcacaacatcctaaaaaaatatgaatgaactgccgctttattgttcatataattcttaaaaagagaaatttatcctccggtctctttaaaaacgcagtgaatagccttattaattggtatactgaagttgcttcagaagaaaaacacgcattgaacctcgagaaccgttgtcttataacacgtaccaggggggcatgatggaaaagaataatgaagtcattcagacccatccgcttgtaggatgggacatcagcaccgtcgatagctatgatgcgctgatgctgcgtttacactaccagaccccaaatcgtccggaaccggaagggactgaagttggtcaaacgctctggttaacgacagatgtagccaggcaatttatttcaatattagaagccggcatcgccaaaatagaatcaggcgattaccaggaaaacgagtatcgtcaccattagcgtgacgcgctccccctctctcaggcaccgtaaggtgcctcacttatttctggcttgtatatctcagcgcagttatttaccttgaaatcatcgcgatagcagagagaagctgatgaaatacgaccttattattatcggcagcggttcggttggcgccgccgctggttattacgccacccgcgccgggctaaaggtcctgatgaccgatgcgcatatgccgccttatcaacagggcagccaccacggcgatacccgtcttatccgccacgcttatggtgaaggcgaaaaatatgtcccgctggtgcttcgcgcccagacgctttgggatgagctctccacacacaatgaagagcctatttttgtccgctccggcgtcgtcaacctcggcccggccgattccgctttcttagccaacgtcgcacgaagcgcgcaacagtggcaattgaacgtcgagcgcctggacgcgacggccctcatgacgcgctggccggaaattcgcgtgcccgataattatatcgggctgtttgaagctgactccggtttcctgcgcagcgaattagccattaccacatggcttcgtctggcccgagaggcaggctgcgcacagctattcaacagcccggtaagccatattcaccatgatgataacggtgtgacgatagagacgagtgaaggctgctaccacgccagcaaagcgctgattagcgcgggcacctgggtcaaaacgctggtaccggagctgcccgttcagcccgtacgtaaagtttttgcctggtttaaggcggatggacgttacagcactaaaaaccgctttccggcctttaccggcgaaatgcccaacggcgatcactattacggtttcccggcggagaacgacgagttaaaaatcggcaaacacaatggcgggcagcgaatacaggcaccggaagagcgcaagccctttgccgccgttgccagcgatggcgcggaagcatttcctttcctgcgtaacgtactgccgggtatcggcggttgtttacatggggcggcatgtacctatgataattcgccggacgaggattttattatcgatacgctgcctggccatgagaatacgcttgtcatcactggactcagcggacatggttttaaattcgccccggtgttaggagaaatcgctgcggattttgcgttgggaaaaacgccctcctttgatctgacgccgttccggctttcccgttttagccaataatttgtcggccccgtaaaggggctgtttattaaggtaagctatgcgtcgtctctttcattttctgatgaataatattcgcgaacatttcatgctttacgttattctttggtcgctgctggcggtgatggatattgtttatctccttttcttctgattgcttttcattgacgttaactaacacttcctgaaagttcctcactttttatttcataatgttgaagcacggcaataatgccaactcctgccgttgtgcggttacaggagtgaaatatctcgaaacttctgaagctgaatcgcaaacaacatcaaaattattgaaataaaaataaatatcattcaaattcttatttataagttgcattcggcgcttttccacgccattttcattctctcgtgaaatattcattggtgtgtttatgcaatttaaaaatactccacaacgttatggcgtagtttccgccgccctccactggctgaccgccctagtggtctatggcatgtttgcgttgggtttatggatggtcacgctcagttattacgacggctggtatcactaggcgccggaaatacataaaagtattggcatgttactgatgatggcgctgatcgtgcgtattatctggcggctttattctccgccgcccgttgcgttgaccagctattcccgtttaacgcgcattggcgccgccgcgggtcatatccttctgtatctcctgctctttgcgataatcattagcggctacctgatttccaccgccgacggtaaaccgattagcgtctttggctggtttgagattccggccacgcttacggacgcgggcgcgcaggctgacatcgccggaacactgcatctgtggtttgcctggtcgctggtcattatctcgctctcgcatggggttatggcgctaaaacaccatttcatcgataaagacgacacactgaaacgtatgacaggaatgtcgtcatctgactatggagctcaaaaatgaaaaaaaacctgctgggattcaccctcgcatccttgttattcacgaccggttccgccgtggcggcggagtataaaattgataaagaaggccaacatgcgttcgtcaatttccgcatccagcatctgggctacagctggctatacggcacctttaaagatttcgacggcacgttcacttttgacgaaaaaaatccgtcagcagacaaagtgaatgtgaccattaacaccaatagcgtcgacactaaccatgccgaacgtgacaaacacctgcgtagcgcggagtttcttaatgttgcgaaattcccgcaggcaaccttcacctctaccagcgtgaaaaaagagggcgatgaactggatattaccggcaatctgacgctcaatggcgtgactaaaccggtgacgctggaagcgaagctgatgggccagggcgacgatccgtggggcggtaagcgcgcgggctttgaggccgaaggaaaaattaagctgaaagatttcaatataactaccgatctcggcccagcctcacaagaggtggagcttatcatctcagtagaaggcgttcagcagaagtaacgcctggcgaaatgccggatagcagcctttacgccgctatccggcaaaatattactcagccggatcgggaatgctcagtttgctattaagccgaccccgcgatttattaaaaattttgttgccgttctcacgacccgcgcgacgtcggcgctgttcttcctccggcaaggccaactcttcacagcattgttcactacagcagccgttaaatttactggcgcactgcggacactggataaacagcagatggcaaccgtcgtttttgcagttggtatggctatcgcaggacacgccgcactgatggcaatgcgcgataacctcatccgagatgcgctcgcccattcgctcatcaaatacaaagtttttgccgataaagcgaacgggaagcccctgctcgcgcgcgcgacgggcgtactcaatgatgccaccctcaatatgccagactttattgaaaccgttgtgtttcatccaggcgctggctttctcacaacgaataccgccggtacagtacatcactatctttttatctgcatgttcccgcagcatttcaaccgcttttggcaactgttcacgaaacgtatccgccgggatttccagagcattttcgaaatggccgacttcatactcatagtggttgcgcatatcaataaagaccgcgtcaggatcgtccagcatcgcattcacatctgccgccttcagataatcgccgacattactggcgtcaaaactcggatcgtcaataccgtcagcgacgatacggtcgcgaactttcatacgcagcacccaaaatgactttccgtcatcctccagcgcgatatttaaacgcaccccgtccagcgcggggtcgaacgtataaagctgttgacgaaaggtctcaaccttgctttgcggcacgctgatttgcgcattgatgccctcatgcgccaggtaaacgcgaccaaaaacgtccaacgccgtaaacacctgatacaacgcgtcccgcgtctgttgcggcgaggcgatagtgaaatatttataaaaagaaattgtcgtacgcggctcgctttccgccagcattttggctttcagctcgtcattagagatgcggttgtgtaacactggcatggtgtacgtatcctgcaatcagcaaaaaataaagtgggcaggcatgataaggcaagtctcgccaatttacatccacacattttgcgctacatttcctgctttacgctaaataattaacaacaattgtcgatttaatcgccactctcctgctacatatttttgctcaacgcaaaaagatgcgagaatacggagaattgttcgttgaaagacaggatagaaatgacgaagttgcctaagttctccgtggccttactgcacccgcgctattggttaacctggttgggtataggcgcgctttggttggtcgtgcaactcccctacccggtcatctataaattgggttgcgcattgggccacctggcgcgacgcgtaatgaaacgccgcgcgaaaatcgcctatcgcaaccttgaattatgctttccggaaatgagcgcgcaggaacgccacaccatggtggtcaaaaactttgaatccgtcggtatgggcgtgatggaaaccggcatggcctggttctggcccgatcggcgagtgaaccgctggatggaagcgagcggtctggagcatatccgtgaagttaaggcgcaggggctggggttcattctggtaggaatacatttccttacccttgagtttggcgcccgcatgtttggtatgcataacccgggtatcggcgtttatcgcccgaatgataatccgttgctcgactggttacagacctgggggcgcttacgctccaataaatcgatgttggatcgcaaagatctgaaaggtatggttaaggcattgaaaagcggcgaattgatctggtatgcgccggatcacgattatggcccgcgcgccagcgtctttgtaccgttattcgccgtcgaccaggccgctacgacctccggtacctggatgctcgcgcgcatgtctaaagcctgtattatcccctccgtgcctcgccgtaaacccgacgggaaaggctacgaactgatcatccttcctgcggaatattcgcctccgctggagagcgcagaagcgactgccgcatggatgaataagattgttgagcagtgcattatgatggcgccagagcagtatatgtggctgcatcgccgctttaaaactcgccctgaaggcgtaccgtcgcgctattgacaggattgcagccgtcaggctgcaatttttcccctcttttagctttaaaagctccccacattgcgaggctggtaaggtcggcgcataattataattagtacgctcataattaaattgatgatagcgcaaaacgcgcatcatactgtggaacactatgtcaccctctgatgtccccataaactggaaacgcaatctaaccgttacctggctgggctgttttttaaccggcgcggcattcagtctggtcatgccttttctccctctctacgttgagcaactcggcgtaacaggccatagcgcgctcaacatgtggtccgggctggtctttagtattacgttcctcttttcagctatcgcttcccctttttggggcggtctggcggatcgtaaagggcgtaagatcatactgttgcgttccgctctcggcatggccattgtgatgctgttaatgggcatggcgcaaaatatctggcaatttctgatcctccgcgcgttattaggcctgctgggcggatttattcccaacgccaatgcgctcatcgccactcaggtgccgcgccacaaaagcggctgggcgttagggacgctctctactggcggcgtcagcggcgctctgcttggcccacttgcgggcggtctgctcgccgaccattacggccttcgcccggtcttttttattaccgccagcgttttgtttatctgttttctgctcaccttcttttttattcgcgagaatttcctgccggtgagcaaaaaagagatgcttcacgttcgggaagtggtcgcctcgttaaaaaatccccgcctggtgttaagcctgtttgtcaccacgctgattattcaggtggcgacggggtctattgcgcccatcctgacgctctatgtgcgcgaactcgcgggaaatgtcagtaatattgcgttcattagcgggatgatagcgtccgttcccggcgtggcggcattacttagcgccccccggctcggcaagctcggcgacagaattggcccggaaaagatccttatcgtcgcgctgattatttccgtactgctgctgattccaatgtcttttgtgcaaacgccgtggcagctcgcgctattgcggtttctgcttggcgcggcggatggcgcgctgctgccagccgttcaaactctgctggtttacaactctaccaaccagatagccgggcgcatattcagttacaaccaatctttccgcgatatcggcaacgtcaccggccctctcatgggtgccgcaatttccgcgagctatggcttccgcgccgtattctgcgtcacggcaggcgtggtgttgttcaatgctatctattcatggaacagcttacgacggcgcagactggcaatagaatgatttttgcgctttcatacttgcaatatcacagaatcagctattctttccctaaatacctcgtcaaatcaaagggagacactgatgaccatgtatgccacgctggaagaagctatcgatgcagcccgggaagaatttctggctgaccatccaggcctcgaacaagacgaagcgaatgtgcagcagttcaacgttcagaaatatgtactgcaggatggggacatcatgtggcaggtcgaatttttcgccgatgaaggtgaagatggcgaatgtctgccgatgctgagtggtgaagccgcacagagcgtgtttgacggcgattatgatgagatagagatccgccaggaatggcaggaagagaatactttgcatgaatgggatgaaggggaattccagcttgaacccccgcttgataccgaggaaggccgtactgcggcagacgaatgggatgagcgttaattactcataaggcccgtggtgaatatcgagcggcagtagcagtgtatcgaagatcagtgagaagggcagatcgaggatagtgatatagcgccatgcggaatcacgcatatcccactgcacgccagggtaatactggttgccgtgtccttgtccggggatcgttctgctgataatactgccgcagccgctcagggtaatcaccattatgctcaccgcgaatatacgcacctgatacctcatttcactataaaaataccggcatcacgccggtatttttcacctcactccagacctgaagaccttatcccgctgacgatgttcgtccctgcaacgcctgcggattcaggacgagagactgataatggtttacccaggaagagtatctctctggcgcattccagacccgatagtgtaaacgcgccatcgtcaccggatcgctgagcaaaaccagacgccgatcgcggttcagtttctccggcgtttcgtttagcgcctgctccacatgacgatcgcgggctatttccagcaccttactggcgcggtgacgcgcggtggccatcgcggtcgccagcgcattaagcgacgggttaaataccgcatgcataaagccatcgtccagaatacggcggcgattcatctccagatatttatcggtatcgaccaacacctgaggcggcgaatactcttccgggatcaggaacagcttccagcgtttggtgcgtaatcctaccgttgaacgactggagatcaccgaaacaaatggcgacagaatcagcgaaaagacaatcggcgccagccagaacagaaagcgtaaatccagccacgccatacccaccgcccagaccagccccagcagcagttgagagccgtgacgcataaaggcttctccccacggcgtagaatcatcgtcgcgttgcggtgagttccagaccacttcccagccgaggaacgcgctgaccacaaacacggtatgaaacagcatacgcaccggcgccagcaacacggagaacagcacttccagcaatagcgacagcgtaacgcgccagaaaccgccatactctttggtgcctttacaccagatcagcataatactgagcagcttcggcaggaacagcagcaccatcgttgacgcaaacagcgcgattgccagttccggacgccactgcggccagaccggaaaaagctggcgcggctgaaggaaatattgcggctctgttaacgcatgaacgacctgcagcgcggtagaaagcgcgaggaacataaaccataacggcgcggacaggtatgacattaccccggtcaggaacacggcgcgatgcaccgggtgcattcctttcaccaggaacagacgaaagttcatcaggttgccgtgacaccagcggcggtcgcgtttaagctcatccagcaggtttggcggcagctcttcataggagccggggagatcgtaggcaatccagacgccccaccctgcccgacgcattagcgccgcctccacaaagtcgtgggaaagaatcgatccggcgaacgaaccttctcccggcagcggcgccagagcgcagtgctcgataaacggcttcacgcggataatggcattgtgcccccagtagtgcgactcccccaactgccagaagtgcagcccggcggtaaacagcggtccataaacacgggtcgcgaactgttggcagcgggcatacagagtatccatccccgacgctttcggcgaagactggataatcccggcgttagggttcgcttccatcaggcgcaccagcccgctcagacactcgccgctcatcactgagtccgcgtccagcaccaccatatagctgtactgattgccccagcggcggcaaaaatcgtcaatattgccgcttttgcgtttcatacggcggcggcggcgacggtaaaaaatttggccttcgccctgcacttccgcgatgagctccatccacgccttttgctccgccacgcagatatccgggttataactatcgctaaggatatagacgtcaaaatgcgcggcgttgcctgtggctttaacggactcccaggtcgcgcgcagaccggcgaaaacgcggctaacgtcttcattacagataggcatgatcagcgccgtctggtgttccggattgaggggctcatcgccaaccgtagacgcggagatactgtacttatcgcgcccgataagcagttgcaggaagcccatcagcgccgtccagaatccggcagacacccagcagaacagcacggcaaacaaaatcaggataccggtttgcagcatgtagggcaggagctgcataaaggagacccaaatatcctgccccaccatatccataggattgatgagcgcccatccctgatagggcagaatggtcttcatataccaggtcgcgacgacggtttgcgccagagtcaaaattaacaaaatatagcggcgtatagtgccgacggtacgccatttttgctcactcgcctgctcttcttttgtcagacgagaaacatagcgcggcgttacatcccgcccacgcaggcgatcccagaaacggccaaccgggttggttcgccagggatcaggaaacatcgaagagcgcgtcgcttttggcatagcctgcaactgatcgcgcccttcatcatctttaattaactgccccttcgccaatgaatccggccaggcgtgttcaaggcgggcttttacggaaccctgcggtgaatcgtcttctcgcgagtaagtccgatgctcggcatccagcgcctgatgcacggcgcggatgtcagttttcggcaatgccgctttctcacgttcagaaagcagcagtgcgtcaatatactcagttgttttattcattggcaggtaactggtagctccaggtttcacttagcgtctgatcggcattcaccaatgcggcacgcatttccgtggttttcttcgcgtctttgactttcacgcgcagcattaaacgccagcctttagtgactgggttatagcgtacattactgtcaacgatttcaccgttatcgccaatgctggtttgtgcagcgacgggcgtatccggcggcagttttttcatgtcggcgccaacgaaatccaccacaaaggcaatagtgccgtcgggctggcgaatcagattcgactgtttaacgtcgcccgttgagcggcgtgtttgcagcacccaggcattatccggcgcatgaagtttatcttcatcgcggctgaaggtcagagtgtacttgaagttcatctctttacccggttccggcagttgatccggagtccagtaagcgacgatgttatcgttggtttcatcattggtcggaatttcaaccagttcaaccttacctttgccccagtcgcctttcggggtaatccaggcgcttggacgcaggtcatagcgatcgtctaaatcttcaaagcgcgagaactcgcgaccacgctgcaacaggccgaatccctgagggttttccatcgcatagctgctcacagcgaggtgttttggattgttcagcggacgccaaatccactcgccattacccgcatgaatggataagccgttcgagtcatgcaattccggacgatagttggtcgtcggcgacggctggtttggcccaaacaggaacatactggttaatggcgcaacgcccagcttgcccaccttatcgcgcagatagacttttgactgcacgtccaccacggtatcgcggccaggaatgatcacaaaacggtaagcgccggtcgcgcgcggagaatccagtaatgcatagacggtcaaacgcttatcggtgggttttggacgctcaatccagaactcgcgaaagcggggaaactcttcaccagatggtaaggcggtatcaatcgccaggccgcgcgcagataagccatacacctggcctgcgccgataacgcggaaatagctggcgccaagcatactgacgatttcgtcgttcttatctttactgttaatggggtacaggactttgaacccggcgaagcctaaatcttttaccgtgtctttatcgtgctgaacattgccaaaattgaagtaatccgggctgtatttgattcttttgaccgtcgtcgccgtcacttcgttaatcttgaccggcgtatcgaagtacatcccctgatggtaaaattcgagcttaaaaggggtctttaagttgttccagtaggctttatcgctgttaaactggatctgctgataatccgcatatttcatgtcgcggaaaacggagggcaagttgcttttaggcgcctcatagcctttcccggctaaagattgagcttgttttgccacgtcatcaatactgaacgcccagctcgatgatgcgtagagcgttaacataatagctgcgcccaaccaacgcattttcatcatttgtcgtttatgtttcataataagtaagcacttccccctttgtgtgcttatatcgatccgatccattttaatggataatcaggcattacgacaactgaatccaggctttgttcagcgcgctggctcatggattaagcacctcccgcgcctgttttcactttgcgtgcttatcctggagacaggttgtcggagttggtgtagggttgctaccgaatgtaactataattcgccttatggataaggtgaaaaatctgagaatacgtgaccttatatgagctctgtacccgcgccgcgtgaatattttcttgactctatccgcgcatggctgatgttgttagggattccctttcatatctcgttgatctattccactcacagttggcatgtcaatagcgccgcgccatcgtggtggctaaccctgtttaacgattttatccacgcttttcgtatgcaggtgttttttgttatttctggttatttttcgtacatgttatttttacgttatccattaaaacactggtggaaagtacgggtagaacgtgtgggtattcccatgcttaccgcaatccctttgcttaccttgccgcaatttatcctgttgcaatatgtcaaagagaaaacagagaactggcctacactctctgcctatgaaaaatataatacgttagcgtgggaactcatttcacatctgtggtttttactggtgctggtgatattaaccaccgtcagcatcgggatttttacctggttccaaaaaaggcaggaaacaagcaagcctcgtcccgccgctatttcgctggccaaactttcgcttatttttttcctgctgggggtggcgtacgctgctatcaggcgcattatattcatcgtatatccggcaatcctcagtgacggcatgttcaattttattgtgatgcaaacgctattttatgtgccgttttttattctcggcgcgttggccttcattcaccccgatctgaaagcgcgcttcaccacgccctcacgcggatgcactttaggcgctgccgttgcttttatcgcgtatctgctgaatcaacgttatgggagcggcgacgcctggatgtacgaaaccgaatccgtgattacgatggtaatggggctatggatggtgaacgtggtattttcactggggcatcgcttgttaaactttcagtccgcgcgtgtcacctatttcgtgaatgcttcgctgtttatttatctggtgcatcatcccttaacgcttttctttggcgcgtatattacaccgcatatctcctccaacctgatcgggttcttgtgcgggctgatatttgttatgggtattgcgttaattctgtatgaaattcatttacgcatcccgctcctgaaatttctcttttcaggtaaaccgccggtaaaacaagaaagccgcgccgcgatcgggtagttttccgcgcgcgggttcacagcaaccattccacaggtaaaattgccgccaaccgtaccagaactcgctgccagaaacgcgtagcgggttctttctttaacaccttttcctcttcttgctgacgatcgatccagttaattcgtccccagcgatccagccgcagttgccaggccgcatcgcgttggctctgcgtaaaacgcttatgaataagcgtcgccagcgtttcactttcaatgacaaagcccatttcggtatttaaaagcgttgaacggggatcaaaattaagcgacccgataaacaccttactaccatcaatactgaacgttttagcatgtaagctggaacctgagttcccggtgagtccgcgatcatgtacggcggtttcatgttcgcgggtcggtttcagttcgtagagctccacgccatagcgcagtaatttcttgcgccagcgcgcgtaccctgcgtgaacgaccgccacatcgttggccgccagagagttagttaagatggcgatcttcacacctttcctgaccagattaagcaactgcgccacgcctgcgcgcgtagggacaaagtaagcggaaataatgtcgatacgctccgtcggcgaccccatcacgtcaaataatcgctgcggaagaagcgaatggcgctgcgccttcccctcgcctttagaagggtcatcgctaagcaagcgtgtttttgcccaaatcagcggcaacgttccgcgatcgagatccgccataaactggctggtttccagcttatgcagataacggcgggtgatctcatcgttataccaggattcgggaagttcgatacgctgcgtcagttcctgctcagaaagggataatacttgctgcaatgtcgacactgaactacagcgccagtaacgttcaaaatcattggcgacatcattgaccaccgggccaatggccatcacgtccagatcggaaaatagcggctcctcgccagcgccgaaataggcatcgccgatgttgcgcccaccgaccagcgtcactacgccgtcggcagtgtaacttttattgtgcatccgccgattcagccgcgcaaaatccgtcaaatatcccagcgcgcgtagcgtacgaaaagagaaaggattaaacagacgaacttcgatattaggatggctatccagcaagcgcaacgtatcatccagaccaggcgtattgttatcatccagcagcagacgaacatgaacgccgcgcttcgccgccgacagcagaaccgaaaagagcagccgcccggacatatcgtcttcccaaatataatactgcacatccagcgtccgcgccgccatttcggtcaggcggtagcgggcggcaaaagcgtccagactgttatccagcgcaagaatgccgcactctccgggatggcgcgcgcatagcggttcaacggcacgctccaggcgtgttttatcaggcagggtcgtcgccttgctgagtaagtaatcttgcgtaaagccgggcagtttcttcatcataacagacaaagtatacctgttcaggcagagcgtaacgggtaataaaatctgaaaccgtcctgacggcgacttcagcggcctgggcgcgtggatagccataaacgccggtactgattgccggaaaagcgatggaacgaaagtgattcgcctcggcaagcagcaaacaattccggtatgcctcttcgagtagctcagcttcctggtgttcgccgcctcgccagacgggccccactgtgtgaataaccgcctttgccgaaagcttgccagcaggcgtgataaccgcatgtcccgtctgacattcgccctgttgctgacggatgagtttacaggcgtccagcaatgccggccccgccgcgcgatgaattgcgccgtctacgccaccgccgcccattaatgatgcgttagcggcattcacaatcgcatcgacgctaagttgagtgatatcaccctgtatgacctgaagacgtgatgtcataaccccccccttttgtctcaccttatctgcaaagtgtacagcagggctttcaacagagtcgctctttttatatctatgacaccgccgttaacggtactcaatattcatcaccgccaggcttttttgcgcatcgagataatgcagccgtaccgtcgcaatggactgaatatcctgcggtaatccagatgcctgccgaaggtctatccggtgcatttgctttttaccttcgcgtaggcaggttaaatcaatattttcggcgtgagtagaaatatcgcacagtggctcaacaatcgcgccgcgaaaatggataacgccgccctgtaccgtttgttgccctaccgcagaatggataaaaaaagcgcagatacacaggcctatggcagggatatttttcttgattacggacatgttaactcctcaatgattagtcatcctcgagggttcggcgttaccttttagcgacatgccgagacgatgagacgcttttatcgcctctttaatacccaggtcagccaatccatttccgccaccatcaaaaactactgtgcagaaggcggccattgttgtgataaatgcagtgattgtccgtccgaaacagtaacaataattttaaccgagtcctctgaagatatatttacactaagacgagacaactcaatcggttgattagcaggtaaagatagcgtttgtttttgctgtgtatggctttgtcccccgacgccgtcgcgcacagagagaatttgcaccagacagacgcagggttcgtttaatgtgacctgagggatcaccgtgtaaatatcgccttgctgagtcgtggtaaacgtaatctgatttgaaagtgcggcaaggagcaataaagtatgcataatttcctcccgaaaaaaaacagggcttacgccctgtttttttattagcgcagacgctaaattaatactggttagccgtggcgttgttgccaaaaccaacctgacgcaccattacgctggaatcagatgcggtctgattaaccagcgcggcgttattaccgccgtattgaccgacagtaatatcggagtttttagcgttccactggtcgatggtggcattgtttctgaaaccattctgagtcagttcaatagtactgttatccgcaccctggcctacatcggcgccgttaccataaccgctctgggtaatggtcgtttcagatttacgggcatcgctttgcagagcaagcgcagcgttagcggaaccgtactgataaatgctcaacgtggaatccggcccggaactattgccgccgccgttatgattaccgccgccgccccattgtggaacgacgccagccagagcactgccagaaactacgattgctgcgaatgctgccacttttaaaagtttcatggtaaaacccccatcggattgatttaaaagtcgtaacggtattagcgttgggtgacgcgaatagccatatgcgactgtttctgcactacaactgctgttttctgcgtaccgtactgggtaatattggccttatttccagaacctttctggataatagccgcactattaccgtaagcgctttgcgatatactggcatcgttggcattgcccgtttgctcaatatacgcaaagttataattccctgcctggtcgactttcgcccgattattttctccttcttgtgaaataacggacaatagttttgatccttcctggcgtactctggcactattatccgtgccgacttgaccaataatggccgcctgattaaatgaagacttgcttaattcatttaccgcaaaattatactctgaacgagccagatcataatttgtcgcggttgcaatcccaggcgcacccagtattgtcaacatcataaataacaatttgtttttcatgctgtcaccctggacctggtcgtacatagcgaaaattatctattaccttgttagcgacatgcgttttttgttaacgcgtcgttacgatgaagagtatgtccgtggaaacatttttaataactcacccacgcgtggtattttgttatttaagctcataccaaagtgctaataaaacgatagccatgtgattttttataattgatttttggccacagaagatagtgtatcgcgcacctaaaaaatgaagtgttggtgtgtgttatgccgccatggggatgttcttatgcttcccatggggggcaatacgcacaagacgtgacacacttcgtttttttttgtctttgtgctgtccaggttaatgccacgtctcaaattttaagaaaaaataaaatcaaaacatgacatacaataattaaaatgattaaaaatcaatgaattattataatttgtatgattttttaaatctatgcaataacagcgaaatgtacaactttactatcaaatctaaacttcaaaaaaacccaaaaacaacattttaatatatatttttacatcttgttacaagtttaacacttgctttaagatttgtaatggctagattgaaaacagttaaaagtattttcgtaaatatttttctctttctggataatgggctatttcaacccacagcagtgcaacatctgtcagtacttctggtgcctttattttatgggggcagctgtcagatgtgcgattaaaaaaagtggagtttcatcatgtttaatgaagtccatagtagtcatggtcacacactattgttgatcacaaagccatctctgcaagctacggcattattgcaacatttaaagcaatcgctggccataaccggaaaactgcataatattcaacgttctctggaagatatctcagccggttgcattgttttaatggatatgatggaagcggataagaagcttatccactattggcaggataatttaagccgcaaaaacaataatataaaaacattattgttaaatacccctgacgattatccctaccgtgaaattgaaaactggcctcatattaacggcgtgttttacgccactgaagaccaggaacacgtggtcagcggattacagggtattctgcggggcgaatgctatttttcacaaaaattagccagttacctgattacacactcaggaaattaccgctacaacagcaccgagtccgcattactcactcatcgcgaaaaagagatcctcaataagttacgtattggtgcctctaataatgaaatcgccaggtcgctatttatcagcgagaatacggttaagacacatctttataatcttttcaaaaagatagctgtcaaaaatcgcacccaggcagtttcatgagcaaacgataatctcaggcggtaaggccatgaaacgctatctgacctggattgtagcagcagagttactgttcgctaccggaaacctgcatgccaatgaagttgaagtcgaggttcccggattgttaaccgaccataccgtctcttcgataggacatgaattctatcgtgcattcagcgacaaatgggaaagcgaatacaccggcaatctgaccattaatgaaagacccagtgcgcgttggggaagctggatcaccataacggtaaatcaggacgttattttccagacctttttatttccaatgaaaagagacttcgagaaaaccgtcgtcttcgcattagcgcaaacagaggaagcattaaatcgccgacaaatagatcaaacgctattaagtacgagtgatttagcgcgtgatgaattctaaaacatgatttttatccggaggctgtcatgcgtgttaaacatgcagtagtgctgctcatgcttttttcgccattaacctgggctggaaatatgacgttccagttccgtaatcctaactttggtggaaaccccaataacggttcctttttattgaatagcgcccaggcgcaaaattcatataaagaccccgcttatgataacgattttggtatcgagaccccctcagcgttggataactttacgcaggctattcaatcgcaaattctgggcggcttgttgaccaatattaataccggaaaaccaggacgtatggtgaccaatgattttattatcgatatcgctaatcgcgacggacagctccagctcaacgtcacggacagaaaaacgggaagaacctcgaccatcgaagtgtcaggtttacaaactcagtcaaccgatttttaagctacagtcactaaaggatataaatcatgccgcgcttacttattttggttgccgttttattgttgagcggatgcttaactgccccgccgaaacaagctgcgaaaccgacattaatgccccgcgcacaaagttacaaagatttgacgcacttacctgctcccaccggtaagatctttgtttcggtatataacattcaggatgaaacgggccaatttaaaccttacccggcaagtaacttttccacggctgtgccgcagagcgccaccgctatgttggtcaccgcgctgaaagattcgcgctggtttatcccactagaacgacaaggcttacagaatcttttgaatgaacggaaaattattcgcgcagcccaggaaaacggcaccgtggcgatgaataaccgtatcccgcttcagtcgttgacggcggcaaatattatggtggaaggttctattattggttatgaaagtaacgtcaaatccggcggggtcggcgcaagatatttcggtattggcgccgatacgcagtatcagctggatcagattgctgtcaacctgcgcgtggttaacgtcagtacgggcgagatcctttcttcggtgaacaccagtaaaacgatcctttcctatgaagtacaggcaggcgtgttccgttttattgattaccagcgcttactggaaggcgaaatcggctatacctcgaacgaaccggtgatgctgtgtctgatgtcagccattgaaaccggcgttatcttcctcattaatgatggtatcgatcgcggactgtgggatttgcagaataaagcggacaggcaaaatgatattctggtgaaataccgtgagctgtcagtaccgccagaatcctgatgaatacgacaaagcgtggggaaaaccccacgcttttttattttgtgaccgccgtattcgctgaatgttgctcgcggcgtgatgccagccatagcccactatttttcatggcatagccaaagattagccccagcgccagcgacggtaataccaaccgccagtcaccctgccctgcaaatgtcgcgcaggcgccgataaatgttcccggaacaaaagaaagcaatagctgctttgcctggatacacatcaggaatgccacgatccccgtcaacacgtaactgacaatttccagatgcggcgccaacgcgctaccgtgaataatgaccagcgcccacaccataccgcttaacagcgtacaggcggaaatcaacaatcccttaaagccgccctgcggacaggcgaaataagccgtacagcctaaaaaaccggcccagcttagtaaccccagggagacggccacccatccccatattccagaaaggatgcccgtagtgatagcaatagaaagaagtatgttcatggcgcgcatcataacagaaaagcggcacattaatgagatcacgcacacattttatgcaatgatgcaaaacccgttgcagttaatggtgatttacatcacattattcttcatcttcttcctgaagttcatcccacatggcccctatcgcatcacgcgttagcggcgccagagtgcgccagaatggcgtaacggcatgggcttcaactttaccgaggaaggtattgcaccagggaagcagataatcggcaaataaggtttccagcgcttcactttcatcttcggcagactgatcttccagccaggaggccgcgagcaataaagtgccaatgtgatcggcaggcgtatcggccagcggcatccctcgcgacgttaaaaaagcgcgcacctcagactcttccgcgccttcgacccacgcactgcggtatggcgctaccgcgcactcttccccaacaaataacgcattgtaatcagtggaaatctgcgtgatatcgcagcttttctgtaaacgcgccagcatgtcatcctgctccagcggccagtttgccgccagtttaccttcacggattaacgtaaacagcggaaccagtaaaggatcttgcggttggcggtaaaacaacgatcccagcacacggcacaggattgaaaactcattcattgatatcttcccgtaaataacgattaaagttcggcaaattccggtacaggcgccataccgcgtgattcgagaaaggccagtaagcgctgcggagagacgttcaggattcgatcttccggaaaattcaccgcatccagaattttccggcattcggtgaaatcgccaagcgtaaaggccgtatgggaatcagagcctaacgctacccagcctcccgcatcgcgtacggcggcagcgaccgcgcggcaattatcttcgcttcctttacgcgaatgcagaaaagaagagttgttgatttccagcgctacatggtgtttcgccgccgcctgcgcgatggctttaacctccactggatactttggatttccggggtgactaattatatgcaccttgccgctggcgatggtcgcgatcatcgcctgagtattggtttctttatcatgcggcgcaaaaacgggctcatgaaagcctgcgataatcagatccagcgagtcgaacatctttccggaacaatcaatttcaccgttaatattcttgatattcgcctcaatgccacgcagtatccccacgccgtcaaccagacgcggccagatgcgcatgttaataaaatgccagtgatgcggcgcatcttccatgtccggaccatgatcggtaatcgcaaaaagtttaatgcctttgcgtttggcttccgcgatataatcgctcagagtactgtaggcatgagtgctggcgacggtatgcatatgcaggtcaacgggatacattgctctctcctgtagtcatttccgacaaggatagcaggtatcgccagcgttttttagcgaaacccggcccgcgccgggttgatatcaatatcctctcgcccgatccacctgccccgtcaccggctctcccttctccagctgggtaatggtgcggctaatataatcgatggcttccgccggacgggtgactgccgcaatgtgcggcgtcatggcgactcgcggatggcgccataatggactttcctgcggtaacggttcctggctaaagacatccaacatcgcgccttttagcttaccgctatcaagcgcagccagcagatccgcctcctgaacatgaacgccgcgcgcgagattcagcacgtaagcgccatccggcaattgatccaacaattcgctattaataattcctaccgtttgggccgtattcggcagcagattaatcagcacccgcgtctggttcaggaaagcgcgcagttcttcacgccctacataactttccacgccaggccaggatttgcggctacgactccagcaacgtaacgggaacccccacgcctgtagactttctgccacttttgcgcccagtacccctgcgcctatgataccgacgctaaactcttcgcgggtatattccggcaacggtttccatagcgcctgatttttcagcgcctgataatcatcgaaacgacggaaccagtgtaatacctggctggcggcatactcctgcatttgcaggcccattccggtatcttccagacggaatagaggaatggaggcgtccagcatttccggatgcgcatttaatttactcagaattgcatccacccccgcgcccagcacaaagacggcttttaagcgtcttccggccagcatttcaaccgggggctgccatacaagcgcatagtctgcggggttgttatcaccgaccttccattcacgaacgcgcgcatgtgggagagccttctccagcgcatttacccaccaggcggcgttaaatgtcgggtgataaaaaattatctccatgttatctcctgagcagtattgtgcggaatgtgattgcgcctgttatcagcgttttcaacgggatgtgcagcatagcaaatttcccggcgcgggcaaaaaaagcagttttcgcttattaaagccacagattgatggaagtttgtataaaagcgcttttttttaaaaaagttgattgacgtagaaaggatatttccctacattagcgcccgttccagtaatgctggagcgacaatttggtgaggtgtccgagtggctgaaggagcacgcctggaaagtgtgtatacggcaacgtatcgggggttcgaatccccccctcaccgccatcttcaagttgagagcctgtacagaagtacaggctttttgcttatatgtatcccccaaaccaaggggggatgagaaccaccgaccggggttcgacaactggcgcagccagttggacagaccgggcgcgcagcgaacgggctgcccgaagggcgagcgcagcgagtcaatccccccctcaccgccatcttcaagttgagagcctgtacagaagtacaggctttttgcttatatgtatcccccaaaccaaggggggatgagaaccaccgaccggggttcgacaactggcgcagccagttggacagaccgggcgcgcagcgaacgggctgcccgaagggcgagcgcagcgagtcaatccccccctcaccgccatatttaagaaagagctcgtacgaatgtacgggctttttttcgcattaagcccccgtccattgccggatggcggcacagttcacgggcgccttatccagtctacataagcgcagcgccaccggccaataacaccaccatccggctttaaattttagccaagaatttcagtgagtttaactttgcgcccctcgtttgaagaaagcgtcgcagcatcagcggtagcaatggcatttgtcgccgcttctcccgttagcaatttagcaaactcctcgcctggctccagaccgtttatcacatcatgcaagtactgcatctccagtttcataattgatgagagccacatcggcgtacgtttaccgggtttaccataagcgattgcgccatccatctcgctggatatgttaccgttgcgacgatcatcatcctccgcctggctttcatgcacaagaaagtgtgtttttttgcccgcttttattagataaccagccgtgttttgcatatcaatgagaattgcacctgtcgtgccctcaattaatacatagtgctcagggtagtggaacgatgatccccactgaagtgtcgcgaaacgaccgctttcaaactcaagggtgattaggacaacatcatcttcatcaccaaatttttcacctttgtgcgcaacattccccgccgccattgaaaccagggatggggtttcatccatgatgaacagtgtacaatctagctcgtgaatgtgatggtacagatgcccacctgactttgcgcgaatcttcttccatgagatctcatcctgcacgtcttcaaaaccattacgtttagtgtgaacttgtgtaacttcaccgatttcaccggctttgatgagcgctttagcgtggcgaaccccgtgaaaaaagttcataacgtgacccgccataaaggtaacaccagcttctttgcaggcatcaaccatatccttacaatcctggtaatttaaggcgataggtttttcacaaaacacgtgtttacccgctttagccgccgcaatgaccggcgctttatgtaagtaatttggtgaagcaataattacgcaatccacatcaggatgggtacaaagcgcctccatcgttgaagtggcgacacagttcagctctttcgctatcggagccgcatttaccggatcgtaaatcgcagtgattttcgccccttcaaccttagacataaatcgcgccagttcagcgccaaaataacctgtacctataacaccgtatttcgtcatcatttatcctctattaaaattcttttgttgactgaaacctttcacgacgtgcttttagtctatccggaatggataggccaataatgagtagaattgttgcggtccagaaagcaacaatgaacgttagcgcagcgcctagccccattgttattccaagccaggtcgccgccattgaattgaatgtgcctgatgtcgcagcaagattataaataagcccggtacccaaaccacgaacctcaagaggaaagtagtcgtagagaaatttgggaaccagcccgccaacacctacgttagtcgccattaaaccgaataaacatgcgcccagcagtaaataattatcttgcggaattctgaataacgggaaaatgaataaaaaggacatgagaagaccaatgctgaacgttttcttcaaaccaattctatctgcgcacagaccccaaacgatatttcccaatacagtgccgaatgccgccgccgtcattaaattagagaccacgcccgtatcaaagccctctcccgccaaatatgtaggcagtagaccaaagatcggccagtttgcgccgaaaatagagaacagaacaataaatacacataatgtcagtggaaattgagctcgattaaatagccctttcattgacaaagagaaaactgaccaggcactttgtgaatgctttccgagaccactgagtttggcttcttcccactctttagattcaggagccctggcccggatgtagattactaaaagaacgggtagcaaaccgacaaaaaaagcagcacgccaaccatacgcttcggcaaatgacggcataaaataggctgctatgatgttaccaataccgaaacctgaaaccagaaatgcgctcgctttagattttaaatgctttggccaactttccacggcataagtagaagcgcaagcatacttccccgccatccccataccgacaataaaacgactaagcgtcagcataattacaccggaagccaggccacttaaccctgtacctacagaataggcaactatcgaccacatcattaacggcttacggccaaatttgtctgccagcagaccaaatagcgccccgccaaatggtcgcccaataaaggccgctgtggcaaggaatgcgccctccatatctgtcaatcctaagtcagccttgatcagatacataatgtagaaaatcagcataaagtcgaagccatcaaaaacgtaacccagccatgctgaaaataaagcatttttttgtggacgtgttatctcgctataccacgggaagaattttgctatcacaataaaacccttatttgctgttaccgtctgaaatgcttacggaattaatttttaagtcatatcaattgccgaataagacactatcaaccggcactttccgacaaccgcctgagatcgtagctatgtaaggcgtatattcattgtttatcatccttgttcgtagctacgttaaggacgtgaatactcaagacaaagtctaacgttctgtaacgtagctacgggctataagattatcgatatgaatactaagcaaagattagtacagtaactctttaacctttctcaaaagtggtattgtaatccaacgcgataacgggtctgtctctcatcggtattatttctcaccgctacatttccgacctcaacgtatggtgtaaatgacttattcagtttccaggctaaagccacattatgttcatagtttgtttttttgttatcaaatttaatttgatcgctatccatccaggtaaatttatattccaatttcaactcatcaaaaacataacctatataagtatcaaatctattcgttttctcatcatcattatagttagctgtcttccttgcatagtcataacggtaacgaccagccatataaacaccagaatcaaaattatattgcgcccttaaataaggcttataaattgaagtgtctggaccgctttcaaatataaatccaggctgcaaaacaaaatggtccgtaactttataattataacttacgcccagttctatagcgtttgcgacgagatcgcttaaatgcttatcctgctcaccatctactcctcccgatttaacgctggcatcgacataaaaaccaatgccgttaggaagcttttcaattatagcaatacggtctttattaattctggttctatcagcatattcatgccgataatcaagggttgccgcttgtagatatgatgaaaatgctataaacgaaaccatacccagaagatatctgttgattttcataaaatactccgcttatcaattaactttatttttgtatttaaaaaattattattttaataaattaccatcacgcatggtaaaggaggttacagacgaaacaggtttccctttagcattttcaccaccaataaggaaaacttcatcaccataacttactgatacaccatagccgagaggttgtttcattttacccatatattgccaatggccattaatcaaaccatagacttcatctcgccattttttatttatcccttcgtgggaataaaactttccattagtataattttgttttgctcccggaaaattcgcgccaccaccgacaagcaggacaccgtggctatagcccgaaaatgctccggccaacccttcctgctgttgttctccaggcgatggcggtaactggctgttcttcaaccatgttagcttatcgttatcccacatggcgcggtaaatcacatcggtacgtaaacccggtttgagctcaccattaatcagcatcaagaaattattttccattaccgatgacgatcctgccgtccccgcgcctggcagctcaccggcattcttccatgtgttctctttagcattgtagataaatacgattttattaaaaaaataatctttggcaggtttattaaaataattatagatgactttatttttttcactttcatccgcagccgctatatcaataaaatacttatcaaagatatgctcattaacccctccggtaataagtaccatcgtttcgtttaattttactcccgtatgccctgttaatccaactggagatatagtatcaactttttgccatgtatttttcaccggtgagtatttgtacacatcgctataaacctgcaacggtgattcactgttttttttccctacgccaccaaaaacatacagcttatcatttaaaaataccgacacggattgctcacgagctccaccaggaaacgactttatacgctcccagtctttatgttgctttttaagatcaattttataccaggatgtccctgcggtacctaagccgacataaatcacgccattattatcaatagcgccagtaccatttttcagtggttctggtatatcaggaagcgtggttgcatatcctgatgtggtgatagcaactgataaacatagcgccattagcgtcatcattttcttaaaatttttcatctgcatccccatgcgaagaaatacaactggagtaaagcttcatcattagtgatcttatggtgcataatttcaacaatgaaaatgacaaaatgtgaccaagcgctaaaaataattacatggggttaccatgtgcgaggtaaaagcacactatggtgatgttagaagtgattatgggtgacctgttatgggcaaactcattagtgattgcattctgaataaatacaacaagaattatgtgatgcatttcatactggctatcccgtggcgtataagctccttctgagcattttatctttatgccggaagcagttaataaaatacagcatgctgccgtcagaatgaattgtatttgtcttgtagcttcaggttatagcctcaaatccgctggcgcagtaattgaatgacaaacataccttatgactgtgttcacatttttctatctttttgcttgatgcagcaacactccacaacataatataaaacggagtaaaacttcaaaatatataaggcggaactggatgtcactattagccaggctggaacaaagtgtacacgaaaacggtgggctgattgtctcatgccaaccggtaccaggcagccctatggataaacctgaaattgtggctgcaatggcacaggcagcggcttcggcgggtgcggtcgctgtgcgcattgaaggcattgagaatctgcggactgttcgtccccatctttctgttcctattattgggataattaaacgtgaccttacagggtcgccagtccgtatcactccatatttacaggatgttgacgccctggcgcaggcaggtgccgatattatcgcttttgatgcctcattccgctctcgcccggttgatattgatagtttactgacacgtattcgcctgcatggattactggcgatggcagactgttcaaccgtgaatgaaggcataagttgccatcagaaaggaatcgaattcattggtacaacactgtctggctataccggtcccatcacgccggttgagccagatttggcaatggtgacacaactgagtcatgcaggttgtcgtgttattgccgaggggcgctataacacgcctgcactggcggccaatgctattgagcatggtgcctgggcagttaccgttggttccgctatcacccgtatcgagcatatctgtcagtggttcagtcacgcagtaaaacgctgaacaggaaaagaaaatgaacacgcttactattgatatttatgtctcagagaataatccgacgttaagaatgctatcggcaaatacgatacccaggcctgaagcctgtttgaacgcaatatcggatagctgctatttcaggtatccggcaggacatacgtctgggcatcaccattggtggagcataaatgctctgccttttacatctcatgattagcgtcattgagattaacaaaaactattgcttgatctgaatatcgtatcgtctgaatgatgggaagataaaaatacacagacgatgaccgcaacgctactcaaaaccataagcaggaaagaactatgattacacattctttcggcatcgttaattattttgtattatttggctacctcctggccatgatgttagtcggtgtctatttttccagacggcaaaaaacagcagacgattattttcgcggtggtggccgggttcctggttgggcggctggggtcagtgtatttgctactacgttaagctcaattacatttatgtcaattcctgccaaagcgtttacttccgactggacgtttatcattggtcagtatctggctatcgcaattttaccgctggttttttatttctatattccgttttttcggaaattgaaagtcacatcagcctatgaatatctcgaagcacggttcgatgtgcgctgccgtctgttcgccagcatgtcatttatgttgtttcatattggacgtatcgccattatcactttcctcaccgtgctggccttgcgccccttcatcgctatagacccggtgattttggtactgttgattagtgtgatgtgtatcatttatacctggatgggggggaattgaaggagtaatatggactgatgttattcaaggtctcttactttctggcagcgcgatactgatttttatagtgatatgtctcaaagtccagggcggcattggtgaaatttttacggtgacgcagcaggcggataaattctttccggctacgcagttccactggagctggacggaaagcacagtacctgtattgatgattggttttctgtttgccaatattcagcaatttactgccagtcaggatgtggtccaacgctatatcgtgactgactccatagaggaaacgaagaaaacattacttacaaatgccaaactggttgctgtgatccctgttttcttttttgctatcggctcggcattatttgtctactatcagcaacatccacaattattaccggcgggattcaacactggcggcattttgcccttattcgtggtcaccgaaatgccagtcggcattgcagggttgataatctccgctattttcgctgccgcgcagtccagcatctccagcagcttaaacagcatttccagttgttttaattccgatatctatcagcgtttgagtcataaaaaaggaacgccagaaaaccgtatgaaaatagctaagttagttattctggtcgcgggcctgataagtagcgcggcctcggtatggctggtcatggccgatgaatcagaaatctgggatgcatttaatagtctgataggtctgatgggagggccaatgaccggtctgttcatgctgggcattttctttaaacgagcaaatgccgggagtgcggttttaggaattattatcagcgtcattaccgtgctgggcacacgctatgccactgaccttaacttcttcttttatggggtcattggctcgctaagcgtggtgatcagcggcgttattttcgccccgttatttgccccggcaccgccattgacgctggatgaaaaacctgaaccaaaggtgacattatgatttcatgataccacgctataccgacacagcacacggtgacgccaacgcgcggggcgacaataccgggccagatataaaccatccgacagatggcgcgctataaacaccgtaagagcaaacagattactctccagtgatgttctgtcataagttggcaacgcgatgtaaatattccccctcctttacttacatcgcgctttttttcatgccgcagacttgataggctctgctctgttcgatattgcaggctttgtgccgcaatcagccctcaagagcaggaactatatggagcctcaacccccacgtcttaaacccggaaaaatccttgacactctgggtgctatgcaaaaaagcctgacacgtgcctcccagcgtattgcgcaatatattttagccttccccagacaggtgacacagtcatctattgccgatttgtcgcgcgacacacaggccggagaagccacggttattcgcttttgtcgcaccctgggctataaaggttttcaggattttaaaatggacctggccattgaacttgccactaccgagtctgatgacagtagtcctctactggatgccgaagttagcgaatccgacgatgcccacgccattggtttaaaattgcagaacaccattagtaatgtattatctgaaacgctaaatctgcttgatatgcaacaggttctcggtgtcgtggacgccctacgtcactgtcactcagtttatatctttggtgtgggctcatcggggatcacggcgctggatatgaaacacaagctaatgcgtattggtttacggggcgatgcggtaagcaataaccattttatgtacatgcaggctacgctattaaaagcaggcgatgtcgcgatgggtgtcagtcactcgggcacatcgccagaaacagtgcattcactccgattggcccgacaggctggcgccaccacagtcgccattacccataatctgggttctccattatgtgaagaggccgatttttgcctgatcaatggtaatcggcaaggaatgttgcagggtgactcgatcggtacgaaagccgcgcagcttttcgtctttgacctgctctatacccttcttgtacagtcctcgccggaacaggcccgagaaagcaaattacggacaatgaatgccctggacatgacaaaataattcccttcacgtacaggcgtcattttccttttttgtccatgagtctgctggacgctttatagacaacaaagcccggtctcccgggctctgaaagtcaatgctatattagctgtatgcgtggagcgttcgctgacaaagcgccgagcgcacgcagtcgtctttgttgaaatgcacaatccccaccatttcatcttcttcaaagcgttccaacgcatcactcaacccggaacgcacaccgcgcggcaggtcgcattgcgtaatatcgccattgacaatgaccgtgacattttcgcctaatcgcgtcaaaaacattttcatttgcgccgcagtcacattttgcgcctcgtcgaggatcacgaccgcattttcaaaagtacgcccacgcatataggcgaacggggcaatttctaccttaccgatttccgggcgcaaacaatattgcataaaggacgcgcccaaccgtttaagcaggacatcgtagacgggacgaaaataaggcgcgaatttttcagcgatatcaccgggcaaaaaaccaagatcttcatcagcctgcaataccggacgcgtcacaatgatcctctcgacgtccttatgaatcaatgcttctgccgcctttgccgcactgatccatgtttttccgcagccggcttcgccggtcgcaaaaataagctgtttactgtcgatagcgttcagataatgcgcctgtgcttcatttcgcgccttaacaggagaggtatcgcgactatcgcgcgccatgccaatggcttctactccgcccatctgtaccagtgacgtgaccgattcttcttcacgttgcttatgactacgcgaatctcgtctcaacacacgctttgcttcacgacgagctttgatcactgctttttgtcttcccatggatagcaccttgagttgtaggtatacatcacccgcgttctcttgaacgcgattatgcgcacacacatctgagggttggcttccttgtaagccttagcttgctttttgaaacgacgccacacacggctacgcgcaccacatatggcgtcatgggtatggacagtaagggaaatgatgagagcttttaagatgacaagaccaccaccggagagagaatgtccgtacagggtgttgtaactactgtaaacaatgtgtcctggtgcggacattaccattcgcgatctccatagtgagtgaccatcactgccggggaactaccgctattactactaagtacaacacaaaacatcaataatgcaacaatatattcaccaaacattaaccaaacattattgcgtcattgtcagtctcttacagaaagattacacaattatttcattggcaggagactaaaaaagataatcattagctactatgggtattaatggtgaaaacacccataacccattgaatattcaacatataaaagattaaaacggagtaattaacgtgtcctctctcccatcgctaaaacggcattatttatgcaaaattttgtgcggcatacttacgccagtaacgctgactcgttttaatttttgtcattactctattgcgtcaaggctattggtaccattaacaggcgatttcatatatggtcagttagtgattactcgagacgtattacggccgcgttaacggcgctcaagggctaaaaatagtttgagagagcgtcctcatttacctgaacaccttcagtcaatcggtccgggacttatcagaggaccaggcaggcgtataacgccgcctggtaaaatatatccgatggcaataatgctatcggacatgtcggttattccgcctgtagcttcgacggcggcgcggaatgataatgcgcgtccgcttttgcaaagcgttcctgcatcgttgctgtcggcgctttgccaagcaggctaaagattacgatccccaggctgccgaaaatgaagccagggataatctcatacagatccagccagccatattgtttccagacgataaccgtcaccgcgccaataatcattcccgccagcgcgccgttacgtgtcatacgcgaccacatcacagaaaacaggacaacaggtccaaatgccgcgccgaatccagcccaggcgtagctcaccagccccagcacacggttatcaggattcgccgccagcgcaatggcgatcagcgctaccaccagcaccatcactcgccctacccataccagctcttgctggctggcgcttttacgcagaaaagccttatataaatcttccgtaatcgcgctggagcataccagcaactgacagctcaacgtcgacatcaccgccgccaggatagcagacagcagaacaccggcaatccacgggttaaacaggatctgcgccagttcaataaatacgcgttctgagttttggttcaccgccccggccagcgcggggttattgttaaagtacgcaatgccaaagaagcccaccgccaccgcgcccgccagacacagaatcatccaggtcatactgatacgacgcgcatgaacaatactgtgatgggaatccgccgccataaagcgcgccaggatatgcggctgaccgaagtaacccagcccccagcccatcagagaaataatagcgacaaaattcagccccttgagcatgtcgacattctcgatgctcttttgcttgatcacttccagcgactcgctaaaaccgcctacgccgacaataaccatcaccggcgtcaggattaacgcaaaaatcatcaggctggcctgaacggtatccgtccagctaacggcaagaaacccgccgataaaggtataaataatggttgccgcggcccccgcccacagtgcggtttcatagctcataccgaaggtgctttcgaacagtcgtgccccagcgacaatacctgatgcgcaatagatagtgaaaaacagcagaatgaccagcgcggaaataatacgcaggactcggctcttatcctcaaaccgaccggtaaaatagtccggcagcgtgagcgcgttattgttaaattcggtatgcacgcgcaggcgcccggccaccagcttccagttaatccatgcgcctaacgtcaggccaatggcgatccagctttcagagatccccgacagaaagatagcgccaggcagccccattaacagccagccgctcatatccgacgcgccggctgataaagccgtaacaaacggccccaggctgcgaccgccaagaatatagtcatcaaagtttttggttgagcgccaggcgataaacccaatcaatatcatgccaaaaatatagacacagaatgtcaccaacatcggtgtgctaatagccatcaaggttctccaaatttatttattggcactaccgtagcgtgccgttttgtaccctgccggaacgtggcaagggtgttatgtttaccagggcgaccgtatcctgccggaatcggtggttattcacaatcgatttaacacaccatttacatcaaatttgattgcagagggatactatttttctccaggttgcactctctcacattttttgcggttgcaccttttaaaagtgttaactaccgcagagaaaataaatccagatggttttccccgtcagactcccactttctttttttaacaatttattcatttttaagcttgcaacgcaggtcacatttaacgcggttgcacaaagttgcaatatagtggatattttccgctaactattggttagcagatagagcgaataacaggagtagagggtatgggaaccaccacgatgggggttaagctggacgacgccacgcgcgaacggatcaaaatggccgcgtcgcgtatcgatcgcacgccgcactggttaataaaacaggcaatctttagctatctggacaagctggaaaatagcgatacgctaccggagctacctgcgctgtttgccggcgcggcaaatgaaagcgaggagccggtcgcgccgcaggatgagccgcatcagccctttctggagtttgccgaacagattcttccccaatccgtctctcgcgccgccatcaccgccgcctggcgccgcccggaaaccgatgcggtgtcaatgctaatggaacaggcgcgcctgtcgccgcctgtcgctgagcaggcgcataaactggcgtatcaactggcggagaaattgcgcaatcaaaaatccgccagcggtcgcgcgggtatggtgcaaggcctgttgcaggagttttccctctcttcgcaagaaggcgtagcgctgatgtgtctggcggaagcgctgctgcgtattcccgacaaagctacgcgcgatgcgttaattcgcgacaaaatcagtaatggcaactggcagtcgcatattggccgtagcccgtcgctgtttgtaaacgccgccacctgggggctgctctttaccggccgactggtctcaacgcataacgaagccaatctttcgcgctcgctgaaccgcattatcggcaagagcggcgaaccgttaatccgcaaaggcgtcgacatggcgatgcgtttaatgggcgagcagttcgtgactggcgaaaccattgctcaggcgctggcgaatgcccgaaaactggaagagaaagggttccgctattcttacgatatgctgggcgaagccgcgttaaccgccgccgatgcgcaggcctatatggtctcttaccagcaagcgattcatgccatcggcaaagcgtctaacggtcgcggtatttacgaagggccaggcatctcgattaagctgtccgccctgcatccacgctatagtcgcgcgcaatacgatcgggtaatggaggagctttatccgcgcctgaaatccctgacgctgctggcgcgccagtatgatatcggtctcaatatcgacgccgaagaggcggatcgtctggagatctcgcttgatctgctggaaaaactctgcttcgaacccgaactggcgggctggaacggcattggctttgtgattcaggcttaccagaaacgctgcccgctggtcattgattatttagtcgatctggcctcccgtagccgccgtcggctgatgattcgtctggtgaaaggcgcctactgggatagcgagatcaaacgcgcgcaaatggaagggctggagggctatccagtttatacccgcaaagtgtataccgatgtctcttatctggcctgcgcgaaaaaactgctcgccgtccctaatctgatctacccgcagttcgcgacccataacgctcacacactggcggcgatttatcatctggccgggcaaaattactatccgggtcagtacgaattccagtgcctgcacggcatgggagaaccgctgtatgaacaggtcaccggtaaagtgggggacggaaaacttaaccgtccctgccgtatttacgcgccggtgggaacacacgaaaccctgctggcctatctggtacgacgcctgctggaaaacggcgccaacacctcttttgtcaaccgcatcgccgatgccaccctaccgctcgatgaactggtggccgacccggtcgaggccgtggaaaaactggcgcagcaggaaggtcaggctggcataccgcatccaaaaattccgctgccgcgcgatctgtacggcgaaggtcggataaactccgccggacttgatttagcgaatgaacatcgcctcgcctcgctttcttctgccctgttaagcaacgccatgcagaaatggcaggccaaacctgtgctggaacaaccggtggccgacggtgagatgacgccggttatcaacccggcggaaccgaaagatattgttggctggggacgcgaagcgacagaaagcgaggttgaacaggcgttgcaaaacgcggtcaatcaggcgccggtttggtttgcgacgccgccgcaagaacgcgccgctattttgcagcgggcggcggtattgatggaagaccaaatgcagcagttgattggcctgttggtgcgtgaagcggggaaaacgttcagcaacgccattgccgaagtgcgcgaagcggtagacttcctccattattatgccggtcaagtgcgtgacgatttcgataacgaaacgcatcgcccgttagggccggtggtctgtatcagtccgtggaactttccgctggccattttcactggccaaatcgccgccgcgctggcggcaggtaacagcgttctggcgaaaccggcagagcagacatcgctgattgccgcccagggcattgccattttgctggaagcgggcgtaccgccgggcgtcgtgcaactgttgccgggacggggagaaaccgtcggcgcccagcttaccgccgatgcgcgtgtacgcggcgtgatgtttaccggttccacggaggtcgcgacgttgttgcagcgcaacatcgccacgcgtcttgacgcccaggggcgccctattccgttgattgcggaaaccggcggtatgaacgctatgattgtcgactcttccgcgctcaccgagcaggtggtcgtggatgtgctggcttccgccttcgacagcgccggacaacgctgttccgcgctccgcgtgctgtgtttgcaggacgatatcgccgaacatacgctgaaaatgttacgcggcgcgatggcggagtgtcggatggggaatccaggccgtctgacgaccgatatcgggccggtgatcgatagcgaggccaaagccaacattgaacgtcatatccagacgatgcgcgccaaaggccgcccggttttccaggccgcgcgtgaaaacagcgatgacgcgcaggaatggcagaccggtacgtttgttatgcccacgcttattgagctggaaaacttcgcagaactggaaaaagaggtcttcgggcccgtgctgcacgtcgtgcgttataaccgtaaccaactggcggagcttatcgaacagattaacgcttccggctacgggctaacgctgggcgtacatacccgtattgatgaaaccattgcgcaagtcaccggttccgcccatgtcggcaacctgtacgttaaccgtaatatggtgggcgcggtcgtcggcgtccagccgtttggcggcgaaggcctgtccggcaccgggccaaaagcgggagggccgctctatctctaccgcctgctggcacaccgcccgcccaatgcgctcaatacgacgctgactcgtcaggatgcgcgttacccggtggatgcgcagcttaaaaccacgccactcgcgccgttgaccgctctgacgcaatgggcggcggatcgcccggcgctacagacgctctgccgacaattcgccgatctggcgcaggccggcacgcagcgcctgctaccggggccgaccggcgagcgtaatacctggacgctgttgccgcgtgaacgggtgttatgcctggctgatgatgaacaggacgcgttgacgcagcttgccgccgttctcgccgtcggcagtcaggcgctatggtcagacgacgccttccaccgcgatctggcgaaacgtctccccgccgccgtcgcggcgcgtgtccagtttgcgaaagcggaaacgctgatggcgcagccgtttgacgcggtgattttccacggcgactccgacaagctgcgaaccgtgtgcgaagccgtcgccgcccgcgaaggcgcgatagtgtcggtacaggggttcgcccgcggcgaaagcaatatgctgctggaacggctctatattgaacgttcgctgagcgtaaacactgccgccgctggcggtaatgccagcctgatgacaattggctaatactgtggttaattaaggctccgtcaatggagcctttttactcgcgtcagaggaccgtatgaaacgaattttccttacctgcgcggcgttgttgttcagcagtcaggcgttggccgatgagtgtgccagcgccagtacgcagctggaaatgaatcgctgcgccgccgcgcaataccaggcggcagataaaaagctgaacgaaacctatcaaagcgcgattaagcgtgcgcaaccgccgcagcgtgagctattgcaaaaagcgcaggtggcatggattgccctgcgcgacgccgattgcgcgctgattcgctcaggtacggagggcggcagcgttcaacccatgatcgccagccagtgcctgaccgataaaacgaacgaacgcgaagcgtttttagcctcgctgctgcaatgtgaagagggtgatttgagctgcccactgccgccagccggttaacgcacgcgaatcccttcaataataatgcgctgaacgctttcgaccgtttggttgaaaaaggcttcatcgcgaagcgtcgcgccggttaccgcttcaacctgaggggcgaaatcggcgtaatgttgcgtggcggcccaaatcatgaagatcaaatgatgcggagaaacgggcgcgagtttcccgctgtgcacccatccggcaatcagcgcggatttttcatctatcaacgcttttagatcgccggtcagttcatccattaagagcggcgcgcccgccagcatctccatgcagaagagccgcgacgcctgcggataatcacgcgaaacctccagcttgagacggatatactctttgatggcctccagaggggaaaattctgcgcgaaacgccttgagcggcgccaaccagacatccagaatctgtcgcattaccgcgacatacagcgcctctttcgagggataataataaagcagattggttttggagacgcctgcccgctcggcgacctgttcaagacgcgcgccatgaatgccatactgggaaaaaacggcaagcgcggcggttaagataagctgccgttttgcaccggtggcctgcgaacgtttcccgatttttttctctgtgcgttgcgacatgcgccctctccttttcgtcaggacgcaagcataccaaatccggcttataaacaaaaaaaccgccggaaatccggcggcggtggcgcatgacgctttttagcgcgaaacgctcagcgtcttgctgttgtgacgcaggctagcgattacggttactgcttttgcccccttttttgcctgcttcggatgcacgctgcgggtcattcttaaaattgcccccgctgtgctgaccacttttacgacctgcttctgatgctctttcgcggtcttccgcaaaattaccggaaccgccacgatggtttgccattactgacctccgtcatagattagacatcatattgcataggtaatgaggagtatctcctcgcgccgcgtatgaacgatatcatcagtaacgccgcgtaaaattaagcatagtgaaaaacgccgtggtaggccgcttaccgaaatattctgcaacatcagaagccgaatatgcagaataataaccatgagaaataaataagttattcttatacttggaaaaatcaaagcgcttaaaaatgtatcattttgcaacaaaggtcgccaaattaattattgttataaatcaaagaaatggcgctgaaatttgcactcttcacaggagggcatatctttaaatagacgtagcgaatcgctacacacctgattaatctgaggagtagtacaaatggcaaagattctggtgctctattattccatgtacggacacattgaaaccatggcgcacgcggtggcggaaggggcaaagaaagtcgacggcgcagaggtcattataaagcgtgtgccagaaacaatgccgcctgaaatcttcgcaaaagctggcggtaaaacgcaaaacgcaccggttgccaccccacaggagctggcggattacgatgccattatttttggtacgccaacccggtttggcaatatgtcaggccagatgcgtaccttcctggaccaaaccggcggactgtgggcatccggcgcgctatacggcaagctcggcggcgtgttcagttctaccggaacgggcggcggccaggagcagaccatcacctcgacctggactacgcttgcccatcatgggatggtgattgtcccgataggctattccgcacaggaactgtttgacgtctcccaggttcgcggcggtacgccttacggcgcaacgactatcgctggaggcgacggttcacgtcaaccaagccaggaggaactctctatcgctcgctatcagggggaatacgtcgccggtctggcagtcaaactcaacggctaatcttcaacaggaggattcgaatgccaactcaagaagcaaaagcgcaccgcgtcggcgaatgggcaagcctgcgtaatacgtcgccggaaattgccgaagccatttttgaagtcgctcactatgacgagaaactggcagaaaaaatatgggaagaaggtagcgatgaggtgctgatcaaagcctttgagaaaacggacaaagactcgctcttctggggcgaacaagtcatcgaacgtaagaacgtataacacaaacgcccccgcctgcgcgggggcatacggctattttgcagcagtgttcatgacgttatcgaacttatccagcggacagaagccgttcgcatccaccggacatcctttcagttccagcgttaccctttgcgcaggcgatttgagcgttaacgcttccgcattacgtaactgccgggcgctctggtagacatactcgattttcatcaaatcccggttagcgttaccgtcatgccagcgttggaagacaagctgaccaccaatcggcgttctctcatactggtcatggagctgatagggtttaaaatccagcgccgtcagcagcgacgcgatattggaatcatgccccaccagcacggtaaccttcggcgcgctaacgcgctcggcaaccagcaccttatcgatatattttaccagcggcgcagcgacattgcgcgccaccgtgggtgaggtaaacaggctgtcctggtagccgtttttcagttttgacagcaccttccactgccgatcggtgtggatcccgccccaagcgacctgatccatcggaaagccttcgtaatattgcagggtaaacgcatccaccagcgagttccctactttcagcggcccctgcacgccaggctcttgctgatagttcgcgctgaaggtatctttcgcgtcgattagcgaacactgatgcttctctttgcaggacggcgagtcctgataatgcgttatctgctcaagcagtttataactctcatcaagatgtagctgactacgcgccttttccatcgcctgtacggcctgttgccggaacgcggcggaatcatcggtaatcaccggattgaaggtagggtccatagtgcccattttttcctgatgatgaacaggaatatcacagccggggaaagcgctggtaatgaaaaattgcgcggtggcgacggtgcgctgcaaactattcgcataggcatataccgtgtcgggcgccggacattctcccgacggtatcagcccctgcgcgaccagccattcacgtgtgtagtgtcccatatagacttccagcacgccgcctttcgtcgtcagttgcccgccgggaacgtcccacgccggccaggcgttcggcgtcgactgcgccagtacgttgccattattcgccagcggcgcccgcagattatggcggctcatcatcagcacctgttgtaattgataaccttccggcgttgtctgcgcctgtacggcggatgacaacaaaacagcccctgccacagcaacagcgagtaatgattttttcatccctatgacctcttgttgttatcaaatcgttctgagtgtgacagaaatggatcatttttccgggaacgatttcgcaaaacggaggtttttcttacagtaaacgcgttagcgccgggaaaccccggcgcatattcagaacgtttttgcccaccacagccgaagcttcatgccccaatagctggtccagccgctggtggtgaacacaacccgaccttgtgaaaccaccaccagcgttggcgtcacgctgatttcccagccagcggataaggcgccgttagcatcattgacgaccgggaagtcaacgcccttgcgcgccagccagcgggcaacctcagcatcaccgccggagcggagcgcaacggtcatgacgttttccccttccgccgccaggtgagcgaccgcaggcgtggtaaagcggcataccccgcaccagctggcccaaaaatagagcagtacggggcgttcctcgctcaaggtcgccagagttgtcgactctcccgtcagcgtatgtaatggtgtcgcggcaaacgccggaggcgcctgcggcgcgcgccagacgtccatgaccaccattatcgcgatgaggagcgccagaaaaaccgcggcttcacgcagccaacgccgcagtttacccgccattggcagccgccagtttttctttcaccaccgcttccagcgtatcccagggcactgcgcccggaatcagctcgtcgccaatgatcgtcgctggcgttccttgcacgtcgaccagtcttgccaactgcaaattagtgcgtatcgtttccatgcttttttcatccagcgtcactggcgtcgcccctgctttctgctgggcctgtttaatactgtcatccgtatggtaaccgcgcttttgcataagtttttcatgtagcgcgaggaactgttgcggatgatcgcgccaggtggtcagcgcaatacgcgccgccagtatggaactctctcctttgaatggcagcggtttaataatgaccgcaacgtcaggatatttctgcacaatcttttccagcatcggatcgagctgtttgcagtacgggcagttgtaatccgtaaagttcaccagcgtcagcttagggtgtttagcgcctatccgcgggctggcaggatcgttaaacaacgccgcatggatcagatttttaatctgcttttcctgatccggcgtaaaaggagcggtttcttgcgcgatgctcagcgtcgaaaacagcgccagcagtaaaacaatcatgtatttcattgggttattcctttcgcttttttcaacgtttgtaataccgcatcgcgggtcagcaaagtgggcagtgcctccccttccggcaaaccggggccatatacctgattaaacggcacggcgacctggccgcgcgttttcagaaaatctgtaatggcatcggacggcagcgtccagtctccccgcagcgccacaacatccggctgttgcaaggcggcctgcacatcctctttttgcaggacgttgtatttattcactttacaggtaatacaccagtccgcagtgacatcgacaaatacccgcttatgctgcgccagcgccgactggattgcctgttcactcaacggttgccactgaaccgtgtcttgcgcgctctttgacgcagtgaagccgaaatgcggcaggagtaacgtcgccagccagatagccgaccccagcatcatcagaccgaggatcctgcgcaggacattcatccaacgcccggggcgcggtaaacgtagcgcaagccctggtcgtatcgcgaccagtagccacggcgcgctcattcccaggccaagcgcaaggaacagcccccacagcgtcggcagcgacgccgtgagcgccaccgcgaccgccgtgcccagaaacggcgcgctacaaggcgtcgccagcagcgtggcgaacgccccctgccagaaatgtcccgacataccgttaccgccgtaagtggccagtttcgtggtcatagatgagggaagcctgaactcaaaaagcccgaacaggctggcgctaaacaacaacatcaccagcgccataaaaccaataaaccatgcattctggaactggactccccaggccagcgcatggtttgacaggcgaaggagggtcataaacgccgccagcgccataaatgacgcaatgataccggcgaccgaagccaaaaattgtcgcctgatgtgagagcggcttttttcctctaccaataaaatagagccaagtttcatgcccagaacaggcagtacgcagggcattaaattaagaatcagtccgccgattagcgccatcattacaacttgccagaaaggtagcgccgcattgtccggcgtttgcgctggcgcagcgccaatggtttgcgtgctctcctgggcgatagcgccatcggctaacacgagggtcagcgatttgtcgcgcaaatcgggcgccttttcgccccaactgtccgtcaccggcaccgtcgcctgtaacctgtcgccctctacgcgcaggcgaggcttcgcaaaatcgacgtcatctatggtgtcaagatagagcccgggcgatgaccagcccgccgctcgcgtagcagtgaccaccagttctcccgggcgatagccaacgtcaagcgagtccgttagcccactgcggagcggaactttacccatcgcccgcgcatagtcatgggcaaaatcggcattctgcacagtgggcgtcacggaaaaggggtaatcggtcaacagacaaacattgctgcaggttgataacgtcaacacaccgcgcaaggtcgccggcggcgtaccgcgcacgatcatcggaaaggtcacctcgtcgtgatatccctgggtggtgatattcgccacatcaaagcgcgagggggttggccagaaccagcttacctcaggcatgtcgcctttccaggcgatagagggtgccacgcccccttcccccggcgcgcgccagtaggttttccagccgttttccagtttgacatccagcaacagccgggtctcactgttagcggacgtatcggcacgtagccgtatgctggcatggtcgttatcgggcgaacgcagccagccgctttccgccgcccaggagacgggcagccaaagccataacaggcagaacagtatccgcctgaataaaatcatcatattttttctccgtgaatgagtaattaaccgttagtaataaccggtctgtcattcacggaagacacaaaatcgtagatgtacccgtaatgtgggcggcgaaatagcccgtggaggcgaaaacggcaggcgcatgacccggacaggcgccagtaaggaaagcagtagataacgcgcaaggatagcaccttcaaagagtactggaggcgccgccagcagcgacttggcgcttaattcgcagggagtgaccggcgagccgtcatctgtcgaggagggagcgctgaccaccgcagcagaggccgtcgcctgcatctgcaaggcgtgcaggcccgccatgcgttgcgcggtacaaaccattaccacgacacatgcaaggcaaagaaaccaccagcccatccgttgttgtttcgccattgcgccctcactgtttaacgcgagttatcttagccactggcgcggttttggcaacctttcccctgtaaagttatgtcggcgcgctgcgcaaccttctgatagtcgaacaacgtaatttattcttactaatgatataactggtgttttcatacgcacttttcaggtttaccctacacttagtggagaaacctttttggggtcccttctgtatgtattgatttagcgagatgatgctatggaacttaaggattattacgccattatgggcgtgaaaccgacggacgatctcaagacgattaagaccgcctatcgccgactggcccgcaagtaccatccagatgtcagcaaagaacccgatgccgaagcccgtttcaaagaggttgctgaagcatgggaagtgctgagtgatgagcaacggcgcgccgagtatgaccagttatggcaacaccgtaacgatccacaatttaatcgccagttccagcaacacgaaggccagccgtataacgccgaagattttgatgatattttctcgtctatttttggtcagcacggtcgtcattcgcaccaccgccacgccgcacgcggtcatgatatcgaaattgaagtggcggtattcctggaagaaacgctggaagagcaccagcgtacgattagctattccgtccccgtttataacgcgttcggcctggtggagcgggaaattcccaaaacattgaatgtgaaaatcccggctggcgtcagcaacgggcaacgaatcagactgaaaggccagggcacgccgggggaaaacggcggacctaatggcgatttatggctcgttatccatattgccccgcatccgctctttgatatcgtcaatcaggatctggaagtcgtccttccgcttgccccatgggaggcggcgctcggcgctaaggtgtctatgccaacgcttaaagagcgtattttgctgaccattccccccggcagccaggcaggtcagcggctgcgtatcaaaggaaaaggattagccagtaaaaagcacactggcgatctctatgccatcatcaaaatcgttatgccgccgaaacctgacgagaaaacagctgccctgtggcaacaactggcggacgcgcagtcgtcctttgacccacgccagcaatgggggaaagcataatggctaacatcactgtcacctttaccatcaccgaattttgtttgcacaccggcgtgacggaagaggagctaaacgaaatcgtcggacttggcgtaattgagccttacgaagacgataacgccgactggcaattcgacgatcgcgcagcgagcgtggtacaacgcgcgctacgcttacgcgaggagctggcgctcgactggccagggatcgcggtcgcgttaacgctgctggaagagaattcacggctgcgcgaagaaaaccggttactgctgcaacgcctttctcgctttatctcgcatccctaatccacgataaaggcaataaaccgagggtgggctttctgcccaccccggatttacatacacccggtataataccagaatgcctctgacatacttcccgcaacggaagaaatatagcctttcaccgcgcacaagccgatcaacgaaccgccaatgtcagccattaatgcgccattgcgaagatcatcgtttaaataaagaccagccacacgctcacattttttagattcgtcggttatttttacacgttagcgatcatttattgcctgaagaatatattctttcactgttttgtactctctggttgatacgtatcttctccctgtcaatgccgggtaaaatgtaccgctgcgcttacaggttgcggtatttataaataagaaatacaacagtcacttacagtttaataattgagcgttataacatccactaccgcccaatatttacaccacgtataaaatacaaaaatgtaatagaatgtaaacaaaataagagcataaaataaataacttattaaaaaatcaatataaatagagtggtcaataaaaaacgatcgttttcaacgagttatgtttctcagattttcatctatcctgaataggcttgcggaaaatgtaatttacaccattgactatttcacttaaaaggtttctgtaatggaatggaaggtcgttgatacagttataagtccctctaccggagtgtcgttctcatgcatacatagcctaaaaaatcttagattgaccttatggtatcaagcagatgtttacatgcctccaggtagcattatcatcccctttaataagggggtcttaataaacgataaactttatcccgttactgtttacaacgttaccaggtttaatcctgttctatggaaatcgcttaaagaaaatagccactgtcctggtaactgcaatcctaaaccagaagcttgcagttatcctttcgagtgtctggtatccgtttgtccatttggtttaaccagaaatattcaaatagataataagaaagtttaggaaataaagtatgcattagccatactactgattaagtgtattcgcgcacgtttgcagtattttgcagttaaatatgtttgatataaaaattgtacagttcggatattttttgattcgtttaatctaaccttcactttggcaacgaggagccggtacagaggatattactgatggccggcagacaaagaaacgcattgcttttaacactgtataaattccatccgtgacattcttatttagtgatatttcaccagagcaatcatcttacctttattgtgcataaaaatcagcaagtagtgtttagaaaaaataatgttttagacaaaagctctgcgcgtcatgctgatcgccaaaagcataacgggctgacatgatgtcagcccgttggtttacccctgccctgatgcttacggtacgcttatcgtcatattgtcatgaccgacaatgacagggcccgggtaatttttcatggcttcctgttgccagacgtcatccgcaaccgtcgcaggcaccagatgacttaacaccagttttttcacgtgggcctcgcgagcaatcttaccgacatcttcaatcgtggtgtgatgcgacgcaatcgcttcagccagcgtttttccgttgccaatactattagccagttttgctaccgaagggacatgtaccgcctcatgtaccaggatatccgccccctgggcaaacgttgcaagcggaggaaaccaggacgtatcgccagagaagacgattcgcttaccctgagtatcaaaacggtaagcaaacgcttcaccgtccgggaaaggggaatgaggcactttcagcgcgcttattgtgaccagttcatctttatagatgacgccctggccgatatcggtcgccttaaccaggttgcgcggatcgggtttcccctcttcttccatgcgtaacgtgatatccctgtcaaagaccttccagctagccttcgtcatcgcctgggttcccggcgggccataaacctgtatggtatggtctttcaggccacttgcccaggcattcatcagcaaggaaggataatccagtatgtggtcgctgtgcagatgggtgagcaaaatagtattgatgttgcgcagtggaatgccatttttcaccagttgcagactggcgccgtagccggcatctatcagccatatcttatcgccgatagtgagcgccgtcgcttgcggtagtctggctgtattgagcaaagaaggcccgcctttggtgcccagtaaaacaatgttgatctcttgaggcgcaggagcaccggcagcaatggcaaggtggctttgcgccagcatacaaaccgccagcatagcgacgctttttttcatcatgtttttactcttcttagttgagaaaagaaggaacttcacgttggcgaaactgcgaaggagaacagccagcaaggcgattaaagaaacgggcgaaataagccggatctttaaaacctaattgccaggcgatctcgttgacagcattgtcggaaaaaagcagcagtcgtttcgcctcgcgtaattgccgatcaaaaatcaggcgtttaggcgggcgattagcaaaacgtcggcaaatatcggtcaaacgagattcggtaatatgcaactcacaggcataatcgggcaccgtccagtgctgatggaagtggttgtcaattaacagggtaaagcgctgaaaaagtttcagttcaccgcgcatcccggttgcggcatgatcgtccagcttcgcattacgcaacagcaaggtaaataccgcctgcgccagtagtaccaaggtatgttcgcagccagccagttgttccgtggactcccgctcaattagctgccagtaatgtttgagcgccgccagctcgttgagtttatccgccagcgacaggcagattcccggcaggccgaaggcctctctggtgccgggataaagcacttccagcagcggccaaaccagctcttcgcgtaccgtcagaacatgaccatcgctatccgattcggtaataaaagcatgcggcaccgagggcggcgttagcacaaatagcggcgcctgcaccgaatagcgatgatcgtcgagctgtagctcaatctgcccggtatcaagaaagtgcatttgaaaaaactggtcgtggcgatgcgcctgcatatcacgaccaaagaaatccgccatacgagcaaacgactgataatgcacatcgttactgcccatgctttcgtcatactctttgctgatatcaatattggcgatcgcacgttggcacatagtttctcctcaaggggtggcgcgcggacgcgatgctttcatgggaatgagccagataatggcggcgccgacgactaacagagaagcgacaaaccagagtccgctattgaagctaccagtgatatcttttagccagccaatcataaccgggctgagcgcggagccaatattgccggtggcattgatgaccgcaatgcctatcgccctggcgcgtaaactgatcgactgatccggcgtggtccagaagatcgccatcgcgctaaaggaacccgtggatgccatcacgatccccaggagctggatcaggttacggtcggtcgccgacgccagcagccagcccgcggcggcaaacaggaacggtaacgcagtgtggtgtttacgctcctgatgtttgtccgaatggcggctccagtaaatcatgcccagaacagtacaaatctgcgggatcgccgccagcaggccgatggtgatattgctgctgccttcattaaaacttttcaggatttgcggcgtccagatactaatggcgctaagcgtattggtaaggcaaaaataggccagcgtatacatcagtacaattggcgtgaatacttcgcgccacaggctacgctgctgcatggcgttatggctgatggccccctcaggctgaaccagcgtcaggcgatcattatccatcatctcctgcaaacattttttatcctctgccgtcagccatttggcttttgccggggtatcatccaggtaaaaccagaccataatgcctaacaaaactgacggaaatccttccaacaggaataaccactgccatccatgcagattgaatatgccgtccagcgataaaatatagccggagacaattgaccccaacgcggtagtggccggcatggcaatcataaataatgcgttggcgcgggcgcggaaaaatgccgggaaccagtaggttaaatagagcaatattcctggcaaaaagcccgcttcggtaatgcccaccagcattcgcagcacatacaggcttttcggtcccaccgcgaacatcgtggcggtagatgcaatgccccatagcaccataatggtcgcaatccagcggcgggcgccgacgatgctcaacatcacgttgctgggaatgccgaaaatgacgtaggtggcgtaaaacagcgtcgtggcaagaccaaacatggtggcgcttaaccccagatcctgccccatcgtcaacccggcaaaaccgatgttgatacggtctaaaaacgagaagataaacaacacgaataaaaatacgatcagtcggcggaacagtttatttatgacggtttgttgacccgtgctgagcgcgttgtgcgaaccgacagactcggggctttccggaagtgcagatgatgtgtcgctcattttttttcctctgatgggaattttgtagggtactacggttgcccggtagcgctgcgcttaccggcccaggcttaatagacgccggacgcaccggacagttttttttctgcgccaaagcgcgccgccagcgcctccgctccgcgcgccagcagcgtggtgtcaacgccgacggcgacaaatagcgcccccagttccagataacgtttcgccagtgcttcattggccatcagaatccccggcgctttccccgccgcgcgtatctgcacgatggcgttctcaatcgccgcctgcacttccgggtgctgcggattgccggcaaagcccatatcggcgctgagatccgccgggccaataaacacgccgtcaatgccatccacgtcgagaattgacgccagattgctcatcgcctcacgcgtttcaatctgcaccagtacgcacatggcgtcgttggcctggtggagatagtccggaatgcgattccagcgcgatgcccgcgccagcgcgctgcccacgccgcgaataccggcaggcggataacgcgtagccgccacggcgtttcgcgcttcatcggcattctgcaccatcggtatcagcagcgtttgcgcgccgacgtcgagcagttgcttaatctgtaccggatcgttccatgacggacgcaccaccggctggctgggataaggcgcaatcgcctgcaactgggtcaacaccgtctgcacgttgtttggcgcgtgttcaccgtcaatcagtagccagtcgaagccggcgcccgctaacagttcagcgctgtaactgttggcaagccccagccacaaaccgatttgcgggcgccccgcttttaacgcgtctttgaaagcatttttcatcgttttttccttacacaaaccggcaactgatcgcgcccatgttgccgtaatcgacatggaaggtgtcgcccttgcgcgccggcaccgggcgggtgaacgagccgccgaggatgatctgcccggcttcaagctggacatcgtagggggcaagcttgttcgccagccacgccacgccgttggccggatgattcagcacgcctgcggcgacgccggtttcttcgatcacgccgttgcgatagagcagcgcggagatccagcgcagatccagctcgtctggtttgatggggcgaccaccgaggatcaccccggcgttggcggcgttgtcggaaatggtgtcgaacactttgcgcgggcgctgggtttccgggtcgatgttgtggctgcgggcgtcaatcagttccagcgccggaatcacataatccgtggcgttgtagacgtcgaacagcgtgcagtgagggccgcgcagcggtttcgccagcacgaacgccagctccacttcaatacgcgggacgataaaacggtcggtggggatatctccgccgtcatggaagaacatatcgtcaagcagcgcgccgtaatccggttcgctgatttgcgagctggcctgcatcgcttttgaggtcaggccgattttgtggcctttgagcgtgcgcccttcggcaatcttgatattgacccattcacgctgtacggcataggcatcttcaatagtgatgttgggataatccagcgacactgcgcgaatctgttcacgctgtttttcagcctgattaagtcgctgagcgatcagggtatgggtctgtttatcgagcatagttgcttcctgttacctcattcggtgctgctgcgccgggtggcgacgcgggtgcgtcttacccggcctacggttcggtactgcttcgtgcatcgtttttttgtaggcccggtcagcgcagcgccaccgggcgaaagagtgtgctatttaaataacgcgtgtacgttgttttgtttgtaattgagcgttggatgtaactcggcaatctcaaacgacagcgccagatagcggttctccatcaggtcggcgaagtgggctttaatcagcccaaacagcatttcgccgacttcctgacggctctccaggctgcgcccggcgccgattttcagcgtcatatgcacaaacgcgtaatcatgcttaccgtcagccatctgccaggtatccagccagtgggcgcgactgcggataccgccgatggggaaaatcccggtggcggccagcgcctcgtttaccttgctgaacaggcttggtaaatcagcctgctcgcgaatattttcagtacattcagcaataaagtgcggcataaaccccccttacgcaggcagcgggaaaacagcgtttacctggccggtaccggagctggcgaacaggtcggtgatgaactccaccttgccgtcgtatttgtcccaccccagcattcccagtagcatgaccgtgtcgtgcatgttgccttcgccgtagcagtagtcggcgtactccggcaacatggtgcaaaactccttgaatttgccttcgcgccacagcttgaccacgcgctcgtccatttgatgatcgaactcgcgggtgtagctgttcatcccctcttccgcccgttggtcgtcaataaaacggtgcgacagagaaccactggcgaataccgctacggtaccgtcatatttctcaatcgccttgagaatggcttcgcccagtttgcggctgtcggcaaaatcatgcacagtgcagaacgccgagatggagaccactttgaagtgcttgtcgctgttcatgtagcgcatcggcaccagcgtgccatactccagcttcaggctcgggatgttgtgcgctttggcgcgcacgcccagtttgaccgcctcgtcggcgatcagatggccgagcgccggattaccgtcatagtcataggtcatgtcgcgaataaagtgcggcaattcgttgctggtatagacgccctggaaatggtcggcacaattaatgtggtaagcgctattcaccagccagtgggtgtcgaatacgataatggtgtcaacgcccatttcgcggcaacgcttgccaatttcaatatgcccatcaatggctgcctgacgacaaccgtgattttttcctggcagttcagaaagatacatcgacggcacgtgggtaatttttgctgctaacgctaacttgcccatatcaaactccccattttgggataggatggtcgcccattgagatgcagacgtttttcatttccgcaaacacttcgaagctatattcgccgccttcgcgcccggtaccggaggctttcacgccgccgaacggctggcgcaggtcgcggacgttctgggtgttgacgaagaccatgccggcttcaatcccacgcgccaggcgcaacactttgctcacgtcctgggtccagatataagaggccagaccgtattccacatcgttcgccaaacgtaacccttccgcttcgtctttgaatggcagcaggcaggcgaccggcccaaagatctcttcctgcgcaacgcgcatacggttgtcgacatcggccagcacggttgggcgcaggaagttaccgcctttcagatgcgcaggcaggtcagtgggtttttccgcaccgcccgccagcagcgttgccccctcttcaatgccgaggcggatataaccggagactttctcccagtgctgttggctaatcagcgcgccgacctgggtgttcgggtcggtcggatcgccgacacgcaggcgattcgcgcgttcggcaaagcgcttcacgaactcagggtaaatgctctgctggataaagatgcgcgacccagcggtgcagcgttcgccgttgatcgagaagatggtgaacagcgcggcgtccagcgcgcgctcaatgtcggcgtcttcaaaaatcagcaccggcgatttgccgcccagctccatcgagtattttttcagcccggcatttttcatgatattgcgaccggtggcggtaccgccggtaaacgacaccgcacgcacgtcatggtggcgtaccagcgcatcgcccgccgtcgcgccgtagccctgcaccacgttcagcacgcctgccggaattcctgcctccagtgccagctcgcccagcctgtcggcagtcagcggcgacagctcggacattttgagcaccgcggtgttacccagcgccaggcacggcgcaactttccaagtcgcggtcataaacggcacgttccacggcgacaccagcgcgcagacgccgacgggctgcaccagcgtataattgagcattttatcgtcaaccggataggtcttgccgttcatctgctggcacacttcggcgaagaattcgaagttatgcgaggcgcgcgggatcagcacgttttagtctggtgaataggcaggccggtgtcggcggtttccatcgccgcgatttccggcacatgctggtcaatcaggtcgccaaggcggcgcatcaggcgcgcgcgctctttcatcggcaggttggcccatttcgggaacgcctcttttgccgccgcgacagcctggttcacttctgcttcaccgccggaggctacttccgccagcacatcaccggtcgccgggttagtggtctggaagtagtcgttacctgcaacgtttttgccgttaatccaatgatttattttcttcattttgcgctctcctcactgacgattcggttaaccaggcgacccacgccttctacttcaacgacaacttcatcccccggcaccacatcggacagccctttcggcgtaccggtggcaatcatgtcgcccggttgcaacgtcataaattcgctcagataagaaatcaggaacgggatgctgaagatcagatcggcggtcgtcccttcctgccgcagctcaccgttgacaaaggtgcgtaacgtcaggttgtgcggatcagaaaccgcctctttatccacaatccacgggcctatcggcgtcaggccgtcgcggctttttacccgcagattcggacggtagtagttttccagatagtcgcggatcgcgtagtcgttacagacggtgtaaccggccacatactccatggcttcggcttcgctcaccttacgcgccgttttgccaatcaccacgaccagctcggcttcgtagtgcatatattcgacgttgttcgggcgcaccgacgtttggtgatgttcggtaaaggtgtttggcgctttgataaataccagcggctctttcggcggcgtaaatgccagctcgctggcgtgatcggcgtagttcaaccccagcgcaaataacgttcccgtcgctgacagcggccacgtaaacgtctggtggcgggcgaattcatcttctgcgacaaccggattttccagcgcgggtaaacctttcgccagaatacgcacccgatcgccgggacgcagcgcaacgcgattctgcggcgtaccaagtaagatcgcatcgccagggttaagtgtagcgaactcacttaacgcgctaagcagttgtgcggcgctacgctgtaaatcggcagtattccagtggtccgcttctcgtccgttgatttcagtgataatggtgagattatccacatcactcagcggcgccatttcacccagcgggcaaaagccatcgcgacatttcgctttaatcgccgggcgataaaagctctcttccggcaggctgacctcgttagccagcgcatacccggcgatatagtccgccgccgcttcagggcgtatccggctggcggttttccccacaatgagcgccactgtcgcgccgctcagtaccttttctccctgcggataaggaatgggttcgccgtgacgaatcaccgtattacgcggcttgatgaaccacactgcggttttaggcggcgcattatagggaggctgagagaaagcctcttgccaggcatcaagctggctgcgatggtttaacgcaacggcgaaaacagtacccttcatacataaactcctcaggccgatttaacgggctgtgatttcattaacatattaatgattagatttatgctttcgctgtacatttagcaagcttaagtaaagtatttatgatgtgattaacaatattttcacaaatttattattaaatacatatatatcaaatagttaaataaaaccccttgtttctattaaactttggacataaaacagatgtcatagctcacatcggtaaacacgattattcaggtattaataattctgcaaaagagaaacgcttatgcatgattcattaaccatcgccttgcttcaggcgcgcgaagcggcaatgacctatttccgccccatcgttaaaagccacaatctgaccgaccagcaatggcgcattgtgcgaatcctggccgatagcccctctatggattttcacgagctggcctttcgtacctgtattttgcgtccaagtctgaccggaatattgacgcgcatggagcgagacggactggtgttgcgactcaagccggttaacgatcagcgtaagttatatgtcatgttgacggagcagggacaaacgttgtacgcccgtgcccggagcgaggtagaagaggcttatcgaaaaattgaggccgatttcacgcccgaaaaaacacagcaattgatgctgctgctggacgatcttattgctctggggcgccagcatcctgatagcgaagcggaagcatagtattcttaccttcccacgccgccgacacgggaatcccctcccgcttacaccctgtgctggaataccgataccggcagcggcggttatacgcataaatttttccgcgtggcgaaaagcgcagacgatctgcgccaacagcgtgatgctatcgccgagtggtcacgcctgagttacggctggatgggacgcacaccggattacaaagccgcctttggctgcgctctgggcgctaacccagccttctacggccagtttgagcagaacgcccgtaactggtacacccgtattcaggagaccggcctgtactttaaccatgcaatcgtcaacccgcccattgaccgccacaaacctgccgacgaagtgaaagacgtctatatcaagctggagaaagagacggacgccgggattattgtcagcggggcgaaagttgtcgccactaactccgccctgactcactacaacatgattggtttcggctcagcccaggtgatgggcgaaaacccggattttgctctgatgtttgtcgcgccaatggatgccgaaggcgtaaaacttatttcgcgcgcctcgtatgaaatggtcgcgggcgcgacgggctcgccgtttgattatcccctctccagccgttttgatgaaaacgatgccattctggtgatggacaaggtgctgatcccgtgggaaaacgtattaatttaccgtgatttcgatcgttgtcgtcgctggacgatggaaggcggctttgcccgtatgtatccactgcaagcctgtgttcgtctggcggtaaaacttgatttcattaccgcgctgctgaaaaaatcgctcgaatgtacgggtaccgtagagttccggggcgtgcaggccgatctcggcgaagtcgtggcctggcgcaatatgttctgggcattgagcgattctatgtgttctgaagcaaccccgtgggtaaacggcgcctggctaccggaccacgccgcgctgcaaacctatcgtgtgatggccccaatggcctacgcgaaaattaaaaatattattgaacgtaacgttaccagcggcctgatttacctgccttccagcgcccgcgatctgaataatccgcaaatcgaccagtacctggcgaaatacgtacgcggctctaacggaatggaccatgttgaacgtatcaaaattcttaaattgatgtgggatgccatcggcagcgagtttggcggtcgccatgagctgtacgagattaactactcgggcagccaggatgaaattcgtctgcagtgtctgcgtcaggcccagagctccggcaatatggataagatgatggcaatggtcgatcgctgcctctccgaatacgatcagaatggctggacggtttcgcatttgcacaataacgacgacatcaatcaactggataagctgctgaaataacgcggcaggaggttctcatgcaagtagatgaacaacgtctgcgttttcgcgatgcgatggcaagtctggcggcagcggtcaacatcgtaaccacggcgggtcacgccggacgctgcggtatcaccgcaacagcggtttgctcagtcactgatacgccgccctccgtgatggtatgtattaatgccaatagcgccatgaaccccgtttttcagggcaacggcaggctgtgcattaatgtacttaaccatgagcaggagctgatggcgcgccactttgccggtatgacggggatggcgatggaggagcgttttcaccagccatgttggcaaaacgggccgctgggccagccggtacttaacggcgcgctggccagtcttgaaggcgagatcagcgaggtacaaaccattggcacgcatctggtgtatctggtggcgatcaaaaatattattcttagccaggaggggcatggcctgatttatttcaaacgccgttttcatccggtcagacttgagatggaagcgcctgtttaaccgtcactcatacccacaagcgggataaccaccgcttgtgggaggagagtcgatacgctgaagatttttattcccgccgcgatgtttgctcgccataaatcccggcgattaataaaatctaagagcctatcccaccaggcgttattggcgcagcctgtttggacacggacagcgcgcaaaaaccggagcgtacacgttgtatgtgaggtttgactcgctacgctcgcccttcgggccgccgcaagcggcgttcaaaacgctaacgcgttttggcgagcactgcccaggaccaaaatggcaagtaaaatagccctaataggataggctctaaattagctcccgcgataggttgaataaccatactgacttaataacagcggcacatgatagtgctcattcgttttgctgatatgaaactcgacgggaatctccgggaaaaacgtgtccagttttttactttcaaaatactggccggttttaaaaataacgcgataatcccccggcgcggcagctttttcgggccacagtgctttaattcgtccatcctggtcggtatgcccggtgtttaattgcgtccatccgttatcctttttctgctccagtaccacctccacgccgggcgctggtttgcctgtttgctgatcgagaatatgtacgctgagaatattgctgccagcggccagcgccattgccggggctgcaacaagagacgctatcgcggtagccagtatatatcgtttcatgcttcactcctttacggtattgatgcaggaaaatatatctggcgcgtccaggattaaccttacacggacatgacaattatgtcatcttgttggagatttacggattcgctaacaagcctatggcatactgcgttgatgaagattttattgattgaagataaccagaaaaccattgagtgggtacgtcagggactcacggaggcaggctatgtggttgattatgcctgtgatggacgagacggattacacctagcccttcaggaacattattcattgattattcttgatattatgctgccggggcttgatggatggcaggttttacgcgcgttgcgcactgcatatcagccccctgttatttgcctgacggcgcgcgactcggttgaggatcgcgtcaaaggtcttgaggcgggcgctaatgattaccttgttaagcctttttccttcgccgaactgctggcccgggtgagagctcaactcagacagcatgtcccggtctttacccgactgacgatcaatggtctggacatggatgccacaaagcaatcggtgttacgaaatggcaaaccgatttccctgacccgcaaagaattcctgctcctctggttactggcgtcccgggcaggggaaatcgtgccccgaaccgcgatcgccagcgaagtttggggaattaactttgatagtgaaaccaacaccgttgatgtcgcgattcgtcggctgcgcgccaaagtagacgatccatttgaaaagaagctcattatgaccgtccaggggatgggttatcgattacaggcggaaacgtcgcagaatggttaagttatcaatgacgctgcgcctgacaatttcttttatcgccatacttatcctcgcctgtaccggcattagctggacgctctataacgcgctgagcaaagaattaacgtatcgggatgatatgacgctaataaatcgggcggcgcaaatgcagcaactgttactggatggcgccaggccggaaaatctgccgctctatttcaatcggatggtggatacgaagcaggatatcttattgatccactcagcaacaggccataatgttgcgattaatcatagcggcatccccgaccaacgctttaacgagattccgctggctaaaaacatcacccgcgaaaccttatttcgccaggcggtacaaggcacggagctgaccgcggtacgagtaaacgccagaagcggcgataacccgctgacccttactattgccaggctggcgacggaaaggcggcaaatgctggcgcaatatcgccgcaacagtttgctgattagccttatcgcgatcctcgtctgttcggcgctcagtccattagtcatcagaaacgggctgcgggccattacgtcgctcagccgactcaccgcggcgacagatagcggcacacttcgccagccgctggcggaacaggcgttacccgtcgagctcaggccgcttgggcaagcgctaaataccatgcgccagaagctttccgacgattttgaacgcctgaaccaatttgccgacgatctggcgcatgagctgcgcacgccggttaatattttactggggaagaatcaggttatgctgagtcaggaacgcagcgccgaagagtatcaacaagcccttgtcgataatattgaagagctggagggactgtcgcgactgacagaaaatattctctttctggcacgcgcggagcaccagaatatagcggtaaaaaaacagcctgtttcgctcaatgcgctggtcgaaaatatgctggattatcttagcccccttgccgaagagaagcacatctgttttataaatcaatgtcagggaacggtatgggctgacgaaatattattacaaagagtgctctcaaacctgctgacgaatgccatccgttattctgatgaaaacgccgtgatacgtattgaaagcgcttatgatgataacgttgcagaaattcgggtcgctaatccgggcagccccaccgccgatgcggataagcttttccggcgtttttggcgaggagataatgcccgctacactgccggtttcggcctggggttatcgttagttaacgcgattgccctattgcacggtggctcggcatcttaccgctatgccgatgaacataatatcttttcggttcgtctgcctgatagcggtgatagctaaggtcagtacaggttctgttccccttccctgccacagggctgtggttatcaatacaacctcaataaaaagaaaataaaggatgccggtaaagaatattgctggctcgatcactttctcggtttccaatccagggtcaattcatcccataacgcgttattcagtgggaacctttatgaaaaagtatcttgctttcgccgttacgctgctgggtatgggtaaagtcatcgcctgtactacccttttggtaggcaatcaggcttcggctgacggctcctttattatcgcgcgcaacgaggatggctcggcaaataacgccaagcataaggttattcatcccgtcgcgtttcatcaacaaggcgagtataaagcacatcgcaacaattttagctggccgcttccggagacagcgatgcgctatacggcgattcatgactttgatactaacgataacgccatgggtgaagccggtttcaattcggcgggcgtcggaatgagcgcaacggaaaccatttacaacggcagagcggcgctggctgccgatccttacgtgacaaaaacgggaatcacggaagacgccattgagtccgtgatcctgccagtggcgcaatcggcgcgtcagggcgccaaattactgggagatattattgaacaaaaaggcgcgggcgaaggtttcggcgtcgcgtttattgatagcaaagagatatggtatctggagacgggaagcggacatcaatggctggcagtacgacttccggcagatagctatttcgtttccgccaatcagggacgtttacgccattacgatccgaatgataacgcgaattatatggcgtcaccaacgttagtaagctttgcgaaaaagcagggattatatgatccggcccgcggcgaattcgactttcatcaagcctattcgcaggataacaaaaacgataccacctataattatccgcgcgtctggacgctacaacaccagtttaatccgcatctggatacggtcgttagcgaaggggaaacattttctgtttttttaacgccaataacgaagatcagcgtggcggcagtaaaaaacgcgttacgcaatcactatcagggaacgtcgcacgacccttatgccagtcataatccacaagaaccatggcgacctatatccgtttttcgtacccaggagtcacatattttacaggtcagaccgaaattaccgcaggctatcggcaacgtagaatacatcgcctatggaatgccatctcttagcgtctatctcccctattaccaggggatgcgtcattatcaacccggagatgataaaggaaccgatcgggcgagcaacgactctacctactggacattccgcacgctgcaaacactggttatgcaagactacaatacgtttgcgccagatgtgcaacatgcctggaaaacatttgaacagcaaacagctaagcaacagtataagatggagcagagctatctgagattatatgcgtcgcatccgaaagaagcacaacgcttactgcaaaattttgaagataaaacgatgcaaaatgcgcagacgctcgcccgtcgcctgaccaataatattattacgacaatgacttaccgcacagatatgaaatatcacttttcaagtacgcagccataaatttaatgacaatctattagccactcatacacaataagataaagcggtaccagaattagccagatataaaagacaataattattatggattcatagagaggatagtttatgacactccagacaaatatcagcagagagacaaaagcggcaaagacccaggaggtatataagcacgttgttcttttcaaaatggccgccccctcttacataagacgataactacagcttatgtcccgtgttacataacttttcccgacaggcctcttttacccatgctgaaaaattccgcgtcttttcagatttcaacgcgaattctatctgttcaagcatggaataggaaaaacgaatattcttcgtcacggtcttactcgtccggggctttgctggcatacacacacctgtataacatttgatgtaacgccgttactttacgcaggagtaaatcggtgaatttgatctgaatcaagaaggtgggttttcaataaaagttgtgccctaaattgtgaagtttgtagattttatgaacatttgatgtaccgatctcccccatgatcgccactacgtatggacgtcaggatgcctccccgcctgatcagaagcgtttcctcattaaaaaggacatttttttaaagttcctggtgcataaaagtcacatccttttaaaagattgttaaccctgttgaatgttcccactcccctattcaggaatattaaaaacgctatgcaaatacagagcttctatcactcagcttcactaaaaacccaggaggcttttaaaagcctacaaaaaaccttatacaacggaatgcagattctctcaggccagggcaaagcgccggctaaagcgcccgacgctcgcccggaaattattgtcctgcgagaacctggcgcgacatgggggaattatctacagcatcagaagacgtctaaccactcgctgcataacctctataacttacagcgcgatcttcttaccgtcgcggcaaccgttctgggtaaacaagacccggttctaacgtcaatggcaaaccaaatggagttagccaaagttaaagcggaccggccagcaacaaaacaagaagaagctgcggcaaaagcattgaagaaaaatcttatcgaacttattgcagcacgcactcagcagcaaaatggcttacctgcaaaagaagctcatcgctttgcggcagtagcgtttagagatgctcaggtcaagcagctcaataaccagccctggcaaaccataaaaaatacactcacgcataacgggcatcactataccaacacgcagctccctgccgcagagatgaaaatcggcgcaaaagatatctttcccagtgcttatgagggaaagggcgtatgcagttgggataccaagaatattcatcacgccaataatttgtggatgtccacggtgagtgtgcatgaggacggtaaagataaaacgcttttttgcgggatacgtcatggtgtgctttccccctatcatgaaaaagatccgcttctgcgtcaggccggcgctgaaaacaaagccaaagaagtattagctgcggcactttttagtaaacctgagttgcttaacagagccttagagggcgaagcggtaagcctgaaactggtatccgtcgggttactcaccgcgtcgaatattttcggcaaagagggaactatggtcgaggatcaaatgcgcgcatggcaatcgttgacccagccgggaaaaatgattcatttaaaaatccgcaataaagatggcgatctacagacggtaaaaataaaaccggacgtcgccgcatttaatgtgggtgttaatgagctggcgctcaagctcggctttggccttaaagcatcagatagctataatgccgaagcgctacatcagttattaggcaatgatttacgccctgaagccagaccaggtggctgggttggcgaatggctggcgcaatacccggataattatgaggtcgtcaatacattagcgcgccagattaaggatatctggaaaaataaccaacatcataaagatggcggcgaaccctataaactcgcacaacgccttgccatgttagcccatgaaattgacgcggtgcccgcctggaattgtaaaagcggcaaagatcgtacagggatgatggattcagaaatcaagcgagagctcatttctttccatcagacccatatgttaagtgcgcctggtagtcttccggatagcggtggacagaaaattttccaaaaagtattactgaatagcggtaacctggagattcagaaacaaaatacgggcggggcgggaaacaaagtaatgaaaaatttatcgccagaggtgctcaatctttcctatcaaaaacgagttggggatgaaaatatttggcagtcagtaaaaggtatttcttcattaatcacatcttgagtcttgaggtaactatatggaaagtctattaaatcgtttatatgacgcgttaggcctggatgcgccagaagatgagccactgcttatcattgatgatgggatacaggtttattttaatgaatccgatcatacactggaaatgtgctgtccctttatgccactgcctgacgacactctgactttgcagcattttttacgtcttaactacgccagcgccgtcactatcggcgctgatgcagacaatactgctttagtggcgctttatcgcttgccgcaaaccagtaccgaagaagaggcgctcactggttttgaattattcatttcaaacgtgaagcaattgaaagagcattatgcataatttaatacgtcaacatactttcttaatgagataaaacgcgatacgtatgccctttacaagagacaaaaccagaatctttggtggaaatgtaaagggcaaacgttcctctttctcattttgctctgtttgcgggagcatttttagtgtgtaagtattcctgctcatcaggtttttacgccatctacgcacatttattctgctataagttgaaatgctgcaaaaaatattaaagcttattattttttctttaagtaaattttcgctcaacaaacttaattgtttattcaatgatgatgaggcgtaagctatgctggaaatgaaggaagtcaatagcaaggataatcttattattcacgggtgatattacttctgcttcaccgttatggcagatatcatcgcctcttgtcagatgccagacacctactcatactcaaccaaagctctaaatacaaaaatcaccttatatctttttttattattccttgtataaatgtgacttgactcacacctataaggaatcgactcacttccataagaaggaatcaaaatgccaataactaacgcgtccccagaaaatatattaagatatttgcatgcggccggtaccggtacgaaagaagcaatgaaaagtgcaacttcaccacgcggtatactggaatggtttgtcaatttttttacctgtggtggagtaagaagaagcaatgaaagatgcttttgggaggtaattggaaaactgaccacatcattattatatgtaaataaagatgctttcttcgatggtaataaaatatttctggaggatgtcaacgggtgtactatatgtctgtcatgtggagcagcatccgaaaatacggatcccatggtcactattgaagtgaacaaaaatggaaaaactgtaacggataaagttgatagtgagagattttggaatgtatgtcgaatgttaaaactgatgagtaaacataatatacaacagcctgattcacttataaccgaggatggttttctgaacctgcgcggagtaaacctagctcataaagatttccagggagaagatttgtcagacatagatgcttctaatgcagatttccgtgaaacaaatctatctaatgtaaatttagtcggtgcaaatttgtgttgtgcaaatctacacgctgtaaatctaatgggttcaaacatgactaaagcaaacctgactcacgcagacctgacttgcgctaacatgtccggtgtaaacttaaccgctgcaattctattcggctcagacttaactgacaccaaactaaatggtgcaaaattagataagatagctctaactttagcgaaagcattaacaggagccgatctgacaggtagtcaacatacccctactccactcccggattacaatgataaaacgcttttcccccatccaatattttagtcgagataaagggattttataaacaagaagtattcaaacagaagccctccttgttttattaaacaaaccccgcccctaagcttcattataaataacattttcagcgtattacttgttggttttgcctgaatcatagcgttatctgtatgtggcacattaactaaaaacactattattgtttaatttaaataattcataattgcagtcagggaataagaaattatgcttccggtcacctacagattaatacctcaaagcggagtatccacatatggattaaataccgcagatacacctgttttccccgatattcccgaacatgcaccaaacccctcacggctacgccttgctcatgacagccttgccataaacagtgaattccgtctggagccagagtgtgtggtggagtaccttatctcaggcgcgggtggaatagaccctgatacagaaattgatgacgacacttatgacgaatgctacgatgaactatcctccgtacttcaaaatgcgtatacccaaagcgaaacattccgcagactgatgaattacgcatatgaaaaagaactacatgatgtggagcagcgctggctaccgggggcaggcgaagcctttgaaactaccgtggctcaggaacacttcaaactttcagaaggcaggaaagttatttgtctcaatctggacgattctgatgattcatataccgaacattatgaaagtaacgaaggaagacaactttttgacacaaaacgttcatttactcatgaagttgtacatgcactgacccatcttcaggataaagaagaaaatcatccaagaggccctgttgtcgaatataccaacattattctgaaagagatggggcatccttcacctcccagaatggtctacatcttcaataaatagacacatcaagaaacgaaaagaaactaaaaacccacgtagtccgttttttcgggaaatgttctagcagtattttctaactatattctaagcgcccaaaaaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaacaaaggggttacctttcggtaaccccttgtttaatctggcggaagcgcagagattcgaactctggaaccctttcgggtcgccggttttcaagaccggtgccttcaaccgctcggccacacttccagaatgaggcgcactataaacatcccggtgcgtcatgtaaagaccgaatgtgttcgtttgcgtgaaaaacaggcaaattttcgttaattgcctgaaatagcggcacattgaccatttcttcaacacaaaaacgggctgaatacgtgttgatcgtccccactgttttacctctgtgattatcaattttttatcggtaacgcgtggttggcgctgccgcctgttttatggcgtagcgccaggcatgagcagaccgttttaacgacggtaatcacctgaaatctcttaaggaaactaaacgtaaacgaatgcgtaaagatgggtaaaaccactgggtgacagtgactgtttttattattctcctttattaattacatctgtcataagagagtgactaatggatcgtatcattacatcatcgcgtgatcgtagctcgctactgagtacgcacaaagtactgcgcaacacctattttctgttgagcctgacgctggctttctccgcaattaccgcgacagccagtacggtactgatgctgccctcccccggcctgattctgacgctggtcggtatgtatgggctgatgttcctgacctataaaaccgccaataagccggtcggtatcctgtctgcttttgcgtttaccggcttcctcggctatatcctgggcccgattcttaacgcctatctgtcagcaggcatgggcgatgtgattggcctggcgctgggtggtaccgcgttagtatttttctgctgctccgcttacgttctgaccacccgtaaggatatgtctttcctgggcggtatgctaatggccgggatcgtcgtcgtgctgattggtatggtggcgaatattttcctgcaactgcctgcattgcacctggcgattagcgcggtgtttatcctgatttcctcgggcgctatcctgtatgaaaccagtaacatcattcacggcggtgaaaccaactatattcgtgcgaccgtcagtctgtacgtttcgctgtacaacatctttgtcagcctgctcagcattctgggcttcgccagccgcgactaatcgacattcccctcttccagccctgcttatgcagggctttattttttgctacactgccgtccgtgttgattacgcagtgaaacgttatgttgatctttgaaggtaaagaaatcagtactgatagcgaaggctatctgaaagagacgacgcagtggagtgaagcgctggcagtcgctatcgccgccaatgaaggcattgagctctctgcggaacactgggaagtcgtgcgcttcgtgcgcgaattttacctggagtttaatacctctcccgccatccgaatgctggtaaaagcgatggcgaataagttcggcgaagaaaaaggcaacagccgctatctgtatcgtctgttcccgaaaggcccggcaaagcaagcgaccaaaatcgccggtctgcccaagccggtaaaatgtatttaataccgaatactaaatcctgttagcgtctcgcgagggctgtgcggttcagtgaggattttgtccacacgagcagagcgcggtccgccttctttcagccacttgatgagcttttctacctgcgccgcgtcgccacaggccaccacttctacgcttccgtcatccatattcttcgcatagccggttaaccccagccgctgcgcctcatgctgcgtggtatagcgaaacccgacgccctgaacgcgaccataaacccaggcgataatgcagacgttcgacatgatggttctcctttcataatcaacggtgaagacgcatacaggacatacttaacgtacctgactgggcagacacccataatgttggcggaatctggccgtaaatcgcgaccccgacaggtagccgcaccgtagcgctatttcgccgatcggcagcgtcgtcgattgcagttgagaaagcgcgcaggacatgcgtacctcttcaataatttgccgataactctgcgattcgcgctgcaaacgccgacgcagcgtcgatgttcccatagcaaggcggcgggctatctcctgggctgtccatagcttagcaggtgagagcataatcagttgccgcacctgctccgtgagggtgtaacgccgttcaataagcagcggtcccgccgcgccatcatgtaaaagcgctaacagtaaccccatcgcctgatgttcctgtagcccaacgggcaacccctggcgcacagcatccaacacgttctcccacataaatgtcaggctacggctcatcggcgtacacagcgatgtcaggtttgccggtggataatcctgaacatacatcgttttaaagcgagcaataatctccggtgaaagtaacaacaggtcggagcgaaaaccgttctgcgcaggctgattaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaataatctccagcggcgtgttcgccggaataataattaactcgccaggcccggcgacaaggcggctatcatcctgaatgatgactttactgccctgcgtaatatggcagatcgcggcggaaaaaagcgtaacacgatgcaaacggtgcagatgactggaacgcacctctgccgtcgtaagatcctgatgtcgaatatgcatctcctgcaccgtgccgtcctctgttttaccttccgtatgtggccgtgaattgtgctttcgcaatcacatgcgcgttaagcataaaccctaccaacgcgccactcgactcactgtcgagcggcagtgttgccgtattcagcgcccacacagtaaactgatagcgatgaggctcatcgcccggcggcggacaggcgccgccaaagccagcataaccgaaatcattccgtccctgcaccactccagcgggtaacgttttttatcagcccccgtcggcaggtcgtgaatctgcgcaggaatattcaccatcgtccagtgccaccagccgcttccggtgggagcatcaggatcgaagacggtaatagcgtagcttttggttccggcaggcggattgcgccagctcagctgcggcgaaatattttctccgctacaaccaaatcctttaaagacgtgctgttgcgttaaacgaaaatctgccggaatatccgcgctactgaggctaaacgccgacgcggcagatacgccgccactcaatgccatcattgcggctgcggtcaaagagaagactgttttcattgtatttccttcttcatgtaaagaaataacactataaaaagcgtccgctgaagaaactgtgcctttacgattctattttgtgcagaaacgctcaccgccatacgctggtgattgcccctctcatctgtgctaccctacgcgccatttcgttttcacggtccctggctggaactatcatccggctcgcgtcactgtttgtgagaggttactccgcatgactgaatctacatttccgcaatatccccgtttagtcctcagcaaagggcgagaaaaatctttactccgccgccacccatgggtcttttccggcgccgtatcccgtctggaaggcaaagccaacctcggtgaaactatcgatatcgtcgaccatcagggaaagtggttagcacgcggcgcctggtcgccagcctcccagatccgcgcgcgcgtctggacatttgataaaacagaatccattgatattgcgtttttcacccgccgcctgcgccaggcgcagcagtggcgcgactggctggcgaaaaaagacggtctggatagctatcgtctgatcgccggtgaatccgatggcctgcctggcgtcactatcgatcgttttggtcattttttggtgctgcaactgctcagcgccggggccgaatatcaacgcgccgcattaattagcgctctgcaaacatgctatccggattgcgctatttacgatcgcagcgacgtcgccgtgcggaaaaaagaagggatggcgctgacgcaaggcccggtcactggcgaactgccgcctgcgcttttgccaattgaagaacacggtatgaaattgctggtcgatatacagggcggccacaaaaccggttattatcttgatcagcgcgacagtcgtctggtgacgcgccgctacgtagaaaatcagcgggtactgaactgcttctcttataccggcggttttgccgtgtcggcgttaatgggtggttgtcgccaggttgtcagcgtggatacctcacaggatgcgctggatatcgccaggcaaaacgttgaactgaaccaactggacttgagcaaagccgaattcgtgcgcgacgacgtgtttaagttgctgcgcgcttaccgtgaacacggcgaaaaattcgacgtcatcatcatggacccgcccaaattcgtcgaaaataaaagccagttaatgggcgcctgccggggctataaagacattaacatgttagcgattcaactgctcaatccgggcggcatactgctgacattctcttgctccggactgatgaccagcgatttatttcagaaaatcattgccgatgccgcaatagatgccggtcgtgatgtacaatttatagagcagttccgtcaggccgccgatcacccggtgatcgccacctacccggaagggctgtatctgaaagggtttgcctgtcgcgtcatgtaacttgaaaagtggaatagtatcctcatataaagggtatctatttcccgggaggtgactatgatagccagcaaattcggtatcggccaacaggtccgccattccctgttaggttacctcggagtggtcgtcgatatcgacccggaatattcgcttgatgagccgtcgcctgatgaactggcggttaacgacgaacttcgcgccgctccgtggtaccacgtggtaatggaagatgatgatggtcagccagtgcatacttatctggccgaggcccagttgcgaagcgaaatgcgggacgagcatccagaacagccatcgatggatgaactggcgcgtaccattcgcaagcagcttcaggcgccgcgactacgtaactgattgtatgtaaaaggccggagagcgatatccggccatttaaacttttatttcgccagccccaggcgagggatctcaatcgccgggcagcgatccatcaccacagtcatgcctgcatcccgcgccagtaccgccgcctgttcgttgatcacgccaagctgtagccacagcgtttttgcgccgatggcgatagcttcctgcgcgacgccccatgcagcttcagagttgcgaaaaacatccaccatatcgactttttcgggaatatccgccagcgtggcatacccctgttgccccagcaatgtcttacccgcgacttttggcgcaaccggaatcacatggtagccctgttcaagcaggtatttcattacccgatagcttggacgatcgggtttatcgctcgcacctaccagcgcgatagtgcgagtggacgtcaaaacatcagcaatatcggtctctttcatcatctttctcctggctgttttgcaaagtgtacgacaaacctgacatagcaaccattcatcccataccgatgtatgagagcaaaacgccaaaatatgtctatatgttagtaaacatgatctaagaaaaatttcgatacattattagccagacggcctttggacaggagaaccttatgaaaaccggcgcgctagccaccttccttgctctctgtttgccggtgactgtttttgccacaacgctccgtttgtctaatgaggttgatctgctggtgctggacggcaaaaaggtgtccagctctttattacgcggcgcagagagcatcgaactggaaaacgggccgcatcaactcgttttccgggtggaaaaaaccatccgcctgcccggtaatgaagagcggctttatatttctccgccgctggtgataagcttcgatacccagctgataagtcaggtcaattttcagctcccgcggctggaaaacgagcgcgaagcctcgcattttaacgcggcgccgcgtctggcgcttttggacggcgacgccatgcccattccggtaaaactcgatattctggccattacttctacggctaaagtggtcgattacgaaatagagaccgagcgttataataaatcggcgaaacgcgcctcgcttcctcagttcgccacgatgatggcagacgacagcacattactttccgacgtctcagagcttgataccgtaccgccgcaatcacaaactctgacagaacagcggctgaaatattggttccgactggccgacccgcagacacgccatcattttctgcaatgggcggaaaaacagccgccctcttgatatgagttgtcccagcgcgcaatttttttgtctttctcttgcagcatcaagcgcttccagtaatctgtagacaggttaactacggaatcgaattatggaactgacgactcgcaccttgccgacgcgcaaacatatcgcgttggttgctcacgaccactgcaaacagatgttaatgaactgggtggaacgccatcagccgttgctggaaaaacacgttctttatgcaaccggcaccacggggaatctgatccagcgcgcaaccggtatggacgttaatgcgatgctgagcggcccgatgggcggcgaccagcaggttggcgcgctcatttcagaagggaaaatcgacgtgttgattttcttctgggacccgcttaacgcggtaccgcacgaccccgatgtcaaagcgctactgcgtctggccactgtatggaatatccctgtcgccactaatgtctcaacggcggactttatcatccagtccccgcattttaatgacgctgtagatattcttattccggattatgcgcgttatctggccgagcgcctgaaataaccgctacgcgggcgggatgctataccgcccgcgctttagggcttcctcgccaccggcacatccagctgtttaagcgcctccacaaagcgcgagggattatctttattgaaaagcagccagacccgcgcacgcgcgcgcgtcaacgccacatataacaaacgccgctcttcagcgtccggaaaatcctcaacctgaggaaaaagcgcactttccataatggattctcgcgccggggcggggaaaccgtcgttaccctcctgcaatccgacaagaatcacgtaatcggcctgttggcctttgctggcatggatagtcatgaaatctatctgtaacttcggccagcgagtcgccgctttttgtagactcgcgggtttcagatggtgatagcgcgccagcaccaggatacgttcatcctccttcgcatagccggataatttatccagtaacgcgtccaactggctttcatccaataacgtaaccgcttttttatcgcctggggtcagactatttaacggttttttaagttggtgcggattctgctgtacaaagcgattggcaatatcgccaatccgactgttaaaacggtacgtggtgtccaggtgacaatgctcgccctcgccgaacgtctgatgaaacgccgtcgttaaggagagctgcgccccgctaaaacggtaaatcgcctgccagtcatcgccaacggcaaacagcgtagtctggctattctgcttgcgtagcgcctctaacagcgccgcccgttgcggggaaatatcctgaaattcatcgaccagaatatgcttccacgggctaataaaacgccctttttcgaggatcaccattgcctgatggatcagcccggagaaatcaacggcattttccgctttcaatgcgcttttccaggccttcagcagcggcgccatcaacttaatgcgtttgccaaacagctcgcggcactcctctggcgcgccagcgatcatttctgcctgcgcgccgccgtgcatacgcatcaaactgacccaacgatccaggcgaggggccagacgccgctgcaatgtctcatcgtcccagaaattaccttccggcactacccactgcatctcctcttccagccactgacgccagcctttggcctgcgcttttttctcgctacactgctgacgccaggtgtgcagaaatagctgatgccgcgcggtggcgtcactttccagcttactgacaaccggcgcttttttactgccttgctgaataatatacagcgccagcgaatggaacgtacgggcagtaatctcttccgtatgtaagcgctcgcggatacgctcatccatctcttctgccgccttgcgaccaaacgccagtaaaagaatttgccccgcatcggcttgcccgcgcgccaacagccaacccgcgcgcgccaccagcaccgaggtcttaccgcttcccgcgcccgccagtaccagtaacgatgattcgccgttaaccaccgccctggcctgggaaggattaagcggagaagattctatctgcgtaaaaaagtcggcatgcgcttccagcatggcatcagcatacgcctgattatgctgctgccgacttccctcgctatcctgtaaccatgccagacacttacgccatatctcgcgacagtgagcaaactcctccagacgtgagaccggcagcggtaaggcggcaaacgtctggcgaatttcgtgttccagcccacgaacgtgttcacgggtaagccattggtttccgcccgttcgctcactaatacgcgcccattgctcctgtaatgcctgcgcggcgacatcactcatctcctggctccagcgacgccagtgcgcgtccagatagcgatggaattgctgggtttccgaccactcggtaccgtgcaaacgcacgactttatcctccgggaggacaaactccagctcgccccataccagcccacgcttacagtgaatcgccaataactgattgaatggaataagatattcatgcctgtcgccagacactttcaccccagcattgaggatcacggcacgatcatacgggtgttgcgccagacgttttccaagagaagttgctttcagttccatgactcagcgaatccagacgtaaagatgtgcttatcagtgtaaccgccagagaaaacgtgctccagtctaaaaaaacgttacaattgcccgcagtaatagaaaaccggaatgaactgagggtttatgcgtaccgttctgaatattttaaactttgtactgggcggctttgccactacgctggcctggctgctggcgacgctggtcagtattgtgcttatttttaccctgccgttgacccgctcctgctgggagataaccaaactgtccctgttcccttacggtaatgaagccattcacgttgacgaacttaatccggcggcaaaaagcgtattaatgaatactggcggtaccttgctgaatattttctggttactttttttcggctggtggctatgcctgatgcacattgcctccggtatcgcgcagtgtgtcactatcatcgggatacctgtcggtattgcgaactttaaaattgccgcgattgcgctttggcctgtcggtcgccgcgtcgtctctgtagaaaccgctcgcgccgcgcgagaagctaacgcgcgccgccgttttgaatgatcgggacaaatagcctttatgttaagtccgttgattcgccgttatacctggaacagtacctggctgtattacatccgcatttttatcgctctgtgcggcaccaccgccctgccctggtggctgggcgacgtcaaactgaccatcccgctcacgctcggtatggttgccgcggcgctaaccgatctcgacgaccgccttgccggacgcttgcgtaatttaatcattaccttaatttgcttttttatcgcgtcggcttctgtggagctgctctttccctggccgtggctatttgcgttgggcttaacgttatccaccagcggatttattctgttgggaggactagggcaacgctatgccaccatcgcgttcggcgcgttactcattgcgatttatacgatgctgggcgcttctttatacgatcactggtatcagcaaccactgctcctgctggcaggcgcagtatggtataacctactgacgctaaccgggcatctgctatttccgatccgtccgttgcaggataatctggcacgcagttacgaacagttggcgcactatctggaactgaaatcacgtctgtttgatcctgatattgaagatgaaagccaggcgccgctctatgatttagcgttagcgaacgggcagttaatggcgacgctgaaccaaacgaaagtgtcgttgttgactcgcctgcgcggcgatcgcggtcaacgcggtacgcgccgcactctccattactattttgtggcgcaggatattcatgaacgcgccagttcttcgcatattcaataccagacgctgcgcgattattttcgccatagcgacgtcatgttccgctttcaacgtctgatgtcgatgcaggcgcaggcctgtacgcagctggcgcgctgtatcttactgcgtacgccgtaccagcatgatccgcgctttgaacgcgtctttacccacattgacgccgcgcttgaacgtatgcgcgccagcggcgcttctttagagctgctgaatacgcttggattcttattaaccaacctacgcgctattgatgcgcaactggcgacgatcgagtcggagcaggcccaggcaatgccgcgcaatgagtcagaaaaccagttggctgacgatagcctgcacgggtttagcgacatctggctgcgtctgagccgtaattttaccccggagtccgctctctttcgccatgcggtacgcatgtcgctggtattgtgcatcggttatgctctcatccaaattaccgggatgcgccacgggtactggatattgctcaccagcctgttcgtttgtcagcctaactataacgcgacccgccatcgccttgcgctcaggattatcggtacgttggtaggcgttgcgatcggcctgccgattttatggtttgtcccttcgcttgaaggacagttagttctgctggtgattaccggcgtgcttttcttcgcattccgtaatgtgcagtatgcccatgcgacgatgttcatcaccctgctggtattactctgctttaacctcctgggcgaaggcttcgaggtagcgttaccgcgcgtcatcgacacgttaattggctgcgctatcgcctgggctgcggtcagctttatttggccggactggcgctttcgcaaccttccccgggtactccagcgcgccaccgatgctaattgccgctaccttgatgcgatccttgagcaatatcatcagggacgggataaccgcctggcctatcgcattgccagacgcgacgcgcacaaccgcgatgcagaactggcatccgtggtttctaatatgtcgagcgaacccgacgtcacggctgaaacccgggaggcggcgttcaggctgctttgcctcaatcacacttttaccagctatatctccgccctcggcgcgcaccgcgaaaagctcagcaatccggacgtgttggggcttctggatgacgcggtctgctacgttgatgatgcgcttcatcatcagccagaagacgaacagcgcgtacaccaggcgctggagggtttaaagcagcgagttcagtcgctggaaacacgtccggacagcaaagaacctctggttgttcaacaaattggtttgctcattgccttactgcccgagattggacgcttgcaacggcaaatttcaccgccgacttctacattaattacccagccgtaagcgaatgagcccagtcggcaagctcctggcgacgactcgccgggagcgccgcttcatgtacgccgacaattgcgccttccagggcatacaaaactttcaccgtcagcaagggattgctttgtcgcaaccttaaccagcacattttcgcgcccagtatgcgtaacatattttcgtcctttatccctgactcattgagcaatgtttccagatggaaggtcatattggggagatctttgagtctgtgctgtaaaatacggctgtgtttttccttcattgccgcgtcaagagaatacttcgataaacgtaccagctgctgctgatcgcgccacaggctttcatccacccggtaatagttgagcataacgggacgtccacatttcataaacatgagccaggcggggggatgcttcacacagtagggtacgctttcttcacaggcgcggagataaagctcgccattagccaccatcgcaaagacggtatcctccacagtcagactatagctaccgaataaagatcgatactggatcgtccccaaagaggccaaatattcttgcgattcatagatcctgtcataagagagtgctctcataaaattccttttaaatcataaagtaaaagaatgatttgcagtaacggatccgttaatgacgaaaataggcaacttatactccgcgagcaagatgatttttatttttgacgccactaagaataaaaattgcgagacagtttccgaaaatagagttgatctttcatcgccacaggagtactgtatgaatatacagtaactcacagggctggattgattatgtacacttcaggttatgcaaatcgttcttcgtcatttcctaccactacccacaacgctgcgcgcaccgctacggaaaatgccgcggcaggactggtcagtgaagttgtctaccacgaagaccagcccatgatggcgcaactcctgcttttgcctttactccgtcagttaggccaacaatcacgctggcagctctggctcacgccgcagcaaaagctcagccgtgaatgggtacagtcttcaggtttgccattaacgaaagtgatgcaaattagccagcttgcgcctcgtcatacgctggagtcgatgatccgcgctttgcgtacaggaaattacagcgtggtaattggttggatgactgaagaactgacagaagaagaacatgccagcctggttgaagcagcgaaggtaggtaatgcggtagggtttatcatgcgccctgtacgtgcgcacgctttacccaggagacagcattccgggctaaaaattcactctaatttgtatcattaagtaaaattaggatttatcctggacttttttttacgcgaacgtatctcctttgagtgctaacgtttttttgcgagaacgcttgccagaagcggtttccgcaatctttgctgtacgatttatcatccgaaactgttaaatgatgtgtatacccgtcatgttttttcacatgtctgacggagttcacacttgtaagtttccaactacgttgtagactttacatcgccaggggtgctcagcataagccgtagatatcggtagagtaactattgagcagatcccccggtgaaggatttaaccgtgttatctcgttggagatattcatggcgtattttggatgataacgaggcgcaaaaaatgaaaaagacagctatcgcgattgcagtggcactggctggtttcgctaccgtagcgcaggccgctccgaaagataacacctggtacgctggtgctaaactgggctggtctcagtaccatgacaccggcttcattcacaatgatggcccgactcatgaaaaccaactgggcgcaggtgcttttggtggttaccaggttaacccgtacgttggctttgaaatgggctacgactggttaggccgtatgccgtacaaaggcgacaacaccaatggcgcttataaagctcagggcgttcagttgaccgctaaactgggttatccaatcactgacgatctggacgtttatacccgtctgggtggtatggtatggcgtgcagacaccaagtctaacgtccctggcggcgcgtctactaaagaccacgacaccggcgtttccccggtattcgcgggcggtatcgagtatgccatcacccctgaaatcgcaacccgtctggaataccagtggactaacaacatcggtgatgccaacaccatcggcacccgtccggacaacggcctgctgagcgtaggtgtttcctaccgtttcggccagcaagaagctgctccggtagtagctccggcaccggctccggctccggaagtacagaccaagcacttcactctgaagtctgacgtactgttcaacttcaacaaatcgaccctgaagccggaaggccagcaggctctggatcagctgtacagccagctgagcaacctggatccgaaagacggttccgttgtcgttctgggcttcactgaccgtatcggttctgacgcttacaaccagggtctgtccgaaaaacgtgctcagtctgttgttgattacctgatctccaaaggtattccgtctgacaaaatctccgcacgtggtatgggcgaatctaacccggttaccggcaacacctgtgacaacgtgaaacctcgcgctgccctgatcgattgcctggctccggatcgtcgtgtagagatcgaagttaaaggcgttaaagacgtggtaactcagccgcaggcttaagtttccgtctgataaaaaaccccgcttcgcggggttttttgctctggtctgggtggcaacgcctttcagcgttacttcttgcctaataacgcctgtaaatcctgctttaacgtggtcatttgcgtggcatatttctctttatgctccgcgtcttctatcagttgcacaatcgtttcggataatgttttaccgcgtcgctgcgcaaggcccgccagacgctgccagaccataaactctaaatcgatagattttttgcgcgtatgctgatgctccgcattgaagtgtcgtttgcgtcttgcccgaatggtttgtctcatccgattaagcaaggcaggattcatatgcctgtctatccagacatttacccgcaccggttcattttcgagggccaacaacaaattgacggcttcctgggcagcactggcttccacgtagcgggtgatcaactccccttcgcggtgctttttcaccagatatttccatttccaaccgctttcaagattttcaagttgttgatatttcattgtgatcccaatgttaccgtgtaactgttatcagaatatcagttttttagccatctgaagaaaagaatctcgaacctgtgaatggttacacgtcttcatattactttgcattcgctttccgcgtgtgcagcgtgacgggttaggctataatccccccttttacaacagactaaaaaacctcaactttgaccattacgaaacttgcatggcgtgatctggttccggatagcgaaagctatcaggagatatttgcacagccacacgcgactgacgaaaacgacaccttactcagtgatactcagccacgactgcaatttgcgcttgagcaacttatacagccgtgggcatcatcctcttttatgctgactaaagcgcctgaagagcaagagtatctcactttactttcagatgccgtccgcgctctgcaaaccgatgccggacaattaaccggcggacattatgacgtttccgggcatactgttcattaccgcgccgcgcagaatgcgcaagacaactttgccaccgtcacacaagtcgtcagcgctgactgggtcgaagccgaacagctctttggttgcctgcggcagtataacggcgacattaccctgcaaccgggactggttcatcaggcgaacggcggcgtgctgattatttccttacgaacccttctggcgcagccgttactatggatgcgtctgaaagccatcgttagccgcgagcgttttgactgggtggcctttgacgagtcgcgtccattaccggtctccgtgccatcaatgccgctcaaactgaaggtgattctggttggcgaacgtgaatcactggctgattttcaggagatggaaccggagctcgcggaacaggctatctacagtgaatttgaagacaatttacagatagcggacgcagaagctatgaccctgtggtgtcaatgggtgacgcgtatcgctttacgcgataatttgccccctccggcaccggacgcctggcccgtcctgatacgcgaggctgtgcgctataccggcgaacaggatacgctgcctctttgcccactgtggatagcccgccagtttaaggaggcgtcgcctttatgcgaaggcgatacctgcggcgcagaagcgctcagtctgatgcttgcccgacgcgaatggcgagaaggctttctggcggagcggatgcaaggcgagattctgcaagagcagatcctgattgaaaccgaaggcgaacgcgttggacaaatcaatgcgctttccgtcattgagtttcccggacatccgcgcgcctttggcgaaccgtcgcgaattagctgtgttgtgcatatcggcgatggcgaatttaacgatattgagcgcaaggccgaacttggcggaaatatccacgctaagggaatgatgattatgcaggccttcctgatgtcggagttgcagctggagcaacaaattcccttctctgcctcgttaacctttgagcagtcctacagcgaagtggatggcgatagcgcctcaatggcggaattatgtgcgctcatcagcgcgctggccaatgtgccagtgaatcaaaatattgcgattaccggctcggtcgatcagtttggtcgcgcgcaaccagtgggcgggctaaacgaaaaaattgaaggtttcttcgccatctgcgagcagcgggaattaaacggtaaacagggcgtgattatccctgccgccaatgtccgccatctcagtcttaaatctgaactgctgcaagcggttaaagaagagaagttcactatctgggcggtagacgacgtgaccgacgccttaccgctactgttaaatctggtgtgggatggcgaaggtcaaacgacgttgatgcagactatccaggagcgtatcgcgcaggcgacgcaacaggaaggccgtcatcgtttcccgtggccattacgttggctgaacgcttttattccgaactgatcggacttgttcagcgtacacgtgttagctatcctgcgtgcttcaataaaataaggtttacataaaacatggtagataaacgcgaatcctatacaaaagaagaccttcttgcctctggtcgtggtgaactgtttggcgctaaagggccgcaactccctgcgccgaacatgctgatgatggaccgcgtcgttaagatgaccgaaacgggcggcaatttcgacaaaggctatgtcgaagccgagctggatatcaatccggatctatggttcttcggatgccactttatcggcgatccggtgatgcccggttgtctgggtctggatgctatgtggcaattggtgggattctacctgggctggttgggcggcgaaggcaaaggccgcgctctgggcgtgggcgaagtgaaatttaccggtcaggttctgccgacagccaggaaagtcacctatcgcattcattttaaacgtatcgtaaaccgtcgcctgatcatgggcctggcggacggtgaggttctggtggatggtcgtctgatctataccgcacacgatttgaaagtcggtttgttccaggatacttccgcgttctaagtgttgaattgatattccgcgctatcggtatcatgcttgcaaagcccataaaggcgaaacctccgcactgcggaggtttctttttctaaagagacagaatcaggccattaccgccctgtcctccatggcttgtcgccaacctcccaaccagtatgaccgttgattcagcgtctgatagggacacatttcttttgatcgtccggcgatgccggcctgatatccacgttgatgtgcccgttccaggcgatctcgtttttgtctcctcatgcctcgtttccctcatatttgtatctggtggaaaagaaaacagtgattacaaaatgtgcaatcacactacacgaatacctctaaatggatcgcccgtcaatgcgcaaaattcacaccaatgtcatatttgtgagctatacggtaaatcatttgtacaaaaaatgtgagccataacaactatttttccggcgtcaaaaataaaaaccgcctcaggcgcacgacctgaagcggttaaatttacattatttttatctcagggaaggcgctttatctcatctgcgatagcggccgcttcctgactccatgcgcttgccagtactttgaccatctcatcatagccatctttctgctggctggcttcgatatggaaaggccgcttaatcagttgtccgttgtggtttaataaccactccccgctgacgataaccttaccatcgtaacgtccatggaatccggttacggtaacgttcaacgtatcctgggtggttcccaacggctgggaagcgacgacccagccaggaagccgggcgctaagattcgccaccagcgtgttacgtaattgctgatccagcgggctggcccacagattgttattggcaatcacatactggacatcactggtttgatacaccacaccgttacctgccagatagtcaggtacggaaacctgctctacccataagagacggttgccctgacttgcggtgctttgcacaccgctttgcgctatcgggagctgataatagcttttattttctccgccggaactacatgacgccagccagaacgccattatcacgactagccattttttcattgtttcgccctcttaggctcaggatcttttttatccttcgcttcaaataccagcgcgttgctcttctcgttcagagttttcaacaccggttgtaactcacgaagcacctgatcgagacgctgcatatccgccaccattttgttatacgccgccgatccaggctggaagccctgcatactgcggttaagttcgcgtaacgtcgtttgcatatccgccggaagctgctgcatcgactgactggaggtaatcttgttcatattatccagcgtggtttgcaaccgacgcatagtacgctggctttcagacagcgtattggtcgcttgttcaatcatcggattcagcggcaggttgttgatcttatccaacgtttccaccagtcgctgttgaatttgcgccaggccgctgctgacggtgggaataatttcataaccatcaaattcgcgtagtccggtaatcggcggctccttaggataaaagtccagatcgacatacagcgccccggtcaccaggttaccggttttaagcgaagcgcgtaaaccgcgcttaagcagttccgtcaaatgcgcgccaacatccgcattttctcccagttgcgctttcagacgctccggttcaatgcgcaccagcacaggaatacggtaatcgtcgttaaacacctgacgcatattagacgcaaagaaaggcactttgcttaccgtccccagacgaataccgcggaactccagcggcgcgccgggttgtaatccgcgcaccgaatctttaaagaacatcaggtaatcgatatgatcggtgtacagcgaatcctgaatacttttttgatcgtcgtagagattaaacgccgttttttcggcgacgggttgcccctgctcaagtccttccggcacatcaaaactcacgccgccgccaaataacgtcgtcaacgatcccatttccacgcgcattcccgccgatgtcagatccacagcgataccgctatctttccagaatcggacattactggtgaccaatcgatcgtttggcgccttaatgaacaactgataactcattgtccgtttttgcggatcgaaagagctggtttcaacggaccctacccgatagccccggaacagaacgggatcgccaggactgagctgaccggcctttttgctgtccagaatcacacgaatacctttggcatcgggcggcgccaacggcggtgagtcaagaagctgatagctttccggctgactgcccttacttcctggttgtagttcaatatacgcgcctgataacaacgtcccaagcccgcttatgccttcacgccccacctgcggttttacgacccaaaataccgagtctttatgcagcaacttttccataccggaatgaagccgcgctttgatttgtacgtgggtcagatcgtcagtcagcgtcgcgctttcaaccacgccgacatccacgctgcgacttttgatcgtcgtttttccgccttcaatgccttccgcattggtggtaattaaggtaacttccggtccctggtggctgtagtgataaaacagaatccaggctccgataagcgcagtaacaatcgggaatatccagacaggcgaccaatttttcaccttttgtactttggcttccccttttttaggttccatgctatcaggactcctcatggcctggttcgtattcacgatcccacgacagacgcggatcaaaggtcatcgcagaaaacattgtcattatgacgactaaagcaaacatcaacgcacccatcgcaggataaatattcattaaccctcccatacgcaccagcgcagagagtacggcaatgacaaagacatcaatcattgaccagcgccccacaaactccactacttcataaataaaatgcatccgttcactgtcgcgcttaccgtggcctttcgcatcccaacaaagccaggcaatggcgatcatttttagcgtcggcaccataatactggcaagaaagataaccgccgccactggataagacccctcgctccacagcaaaatcacgccagccagaatggtcgacggcattttcgagcccagtaagtcagtaatcataatcggcaatatattggcgggcagataaagcatgatcgaggtaaataataacgccagcgtccactgcaaactgtttttacgccggacatagcctttcgtatggcaacgcggacagacgagactctccgcaggcaggatcgccgtacagcaggcgcaagaacgcaaagactgccggataccggtaatccccggcgttaacggctgcgccagtgcaggttgcggggcgatatcatcccacaaccagcggcgatcgacacactggaacgcccgcagttgaacgagacaaaataagcaccagggaataaagctgctgccgatgccgatatcgccgtaagccatcagcttaacaaaactgaccaacaccccggcgagaaatatttccgccattccccacgatttgaggaggaaaaagatccttgccagcgttttttttaccgacaacggcagactggcgcggttgacaagtaatagaatggtcaccaggcaaaatgccggcaccagttggacaaataataaaaagaacgtgccgaggctggcgtaatcttcagaaaacatgacgccggggatttccagaagcgtgacttcgctggtgacgcccgcgacattcatattcacgaagggaaaaaggttagaaagcagcaacataaatagtgccgctaacgcataggcggtaggacgctgccggggcgcgtcccactcggtcgttaacgttgcgccgcatcgtggacatgctgctttttgcccatgcgagaggcggggtaaagccaccagcatgtcgcattgcgggcacaatatgtgcttcgcagcatggtgatgttcacacataggcgctcctttcgttatgccccgtttttcaggccttcaagatactcccaacgttcgaaggcttgctcaagttcttgctccgcctgacttaaatcggccagaactttctgcgtttgctcatggggttggctaaaaaaggccgcatccgcaacctgcgcctgtagcgcttccagcttcgcttccaggtcttcaagctgaccgggtaactgctccagctcgcgctgcagtttatagcttagtttgctactgccacgttttacaatttctgctttaggggcaataacttcctcattttttttcgtcatcggctgtttcgtcgccagatgctgctcttgctgcgcacgcgcatcatggtagccgccgatataacgtccgattttgccgccgccctcgaaaatccagcattccgtcacggtattatcgacaaattgccgatcatggctgaccagtagtaccgtgccctgatagccatcaattaattcttctaatagttccagcgtttcgacgtcaagatcgttcgttggttcatcgagaattaaaagattgctcggcttgaggaacagtcgcgccagcagcagacggttacgttcgccgccggaaagcgcgcggacgggcgtcatcgcccgtttggggtgaaacaggaagtcctgcaaatagcccagtacatggcgcggcttaccgtttaccatcacctcttgcttgccttccgcaaggttatccatcacggttttttccgggtccagttcggcgcgatgctgatcgaagtaggcgacttccagcttcgttcctacgtggatgcgcccgctgtcagcctgaagctgtcccagcatcagtttcagtagcgtggttttaccgcagccgttcgggccaattaacgcaatcttgtcgccgcgctgtacctgagcggagaaatcttttaccagctgttttccttctacctggtaatcgacgttttccatctcaaaaacgattttaccggagcgcgtcgcctcttcgacctgcatcttcgccgtgcccatcacttcccggcgctcgctgcgttcacgacgcatcgcttttaacgcccgcacgcgcccttcattacgggtgcggcgcgccttgatcccctggcgaatccagacttcttcctgtgccagtttgcgatcaaattccgcgttttgtaactcttctacgcgcagcgcttcttctttctccagcaggtattgatcgtaatttcccggataggtgaccagtttgccacgatcgagatcgacaatgcgggtcgccatattgcgaataaacgaacgatcgtgagagataaaaataatcgttccgttaaaggttttcagaaacccttccagccagtcgatagtttcgatatccagatggttagtcggttcatccagtaacaatacgcgcggattgctgaccagcgcccgacccagcgcggctttacgcagccagccgccggagagcgacgacagcgcggcgttaggatcgagtccaagctgcgccagcacttcattaatacggttttccagctgccacagattatgatgatcgagctgttcctgtacgcgcgccatttcattgaggtttttctcgctgggatcggtcatcaccagacgggaaatctcatgatagcgcttgagatattccgcttgttcttcgataccttcggcgacaaagtcatagacgctacccgcaatattacggggcgggtcctgttgcagacgcgcgacgatcagatcctgttcataaataatacgcccatcgtccagaccctgttcgcggttgaggatcttcatcaaggtggatttcccggcgccgttacgccccaccagacagacgcgttcgttatcttcgatatgcaactctgcgttatcgagaagcggcgcgtcgctgaacgacagccatgcgccatgcatactgattaatgacatttacttttcctttcaggcggcgcggatcagccagcaattatgaatctgacggttacgggcaaaatccggggaaagcgttttttgcgtaatttcttgtgcggtaagccccagctcagccagcccttccagatccatacggaatccgcgcttattatttgagaacatgatggtgccgcctttacgcagcaggcgttttaaatctttcattaacgcgacatgatcgcgctgaacatcaaacgactcttccatacgttttgagttagagaacgtcggcggatcgataaagatcaaatcgaactgttcattcgcctcgcgcagccagcccaggcagtcggcctgaatcaggcgatgcgcgcggccgctcagtccgttcagacgcaaattacgttcggcccactccagataggtgcgggacatatccaccgttgtggtgttgcgcgcgccgcccagacccgcatgtacgctggcgctgccggtataagaaaagagattcaggaaatctttgcctttgctcatttctcccagcattctgcgggcaatacggtgatcgaggaacagaccagtgtcgagataatccgtcagatttacccataagcgcgcattatattcgctgacctcaaggaactcgcccttctcgctcattttctgatactggttttttcctttttgccgttcgcgggtttttaacaccagtttattcggcggaataccgagcactgacaaggttgccgcaataatatcgaacagacgttgccgcgctttttgcgcatccaccgttttcggcggcgcatattcctgaatcaccgcccagtcgccgtaacggtctaccgccacgttatattccggcaggtcggcatcatacaagcgatagcattcaatcccttcctggcgcgcccatttctccagctttttaagatttttacgcaggcgattagcgtaatcttccgccaccgtcgccggtttactgtccgccgtggtttccgcaatatgatagtttttctgcacacagtccagcgggccattcttggctttaaactgtttgtcggcgcgtaattgcaggctgcccagcaaatcgggcgaagcgctgaacagcgacaggttccagccgccaaactgatttttcatggtacggcccaacaggctgtgcaacgcaatcagcgccggatcgctgtccagacgttcgccgtaaggcgggttactgatcaccgtaccatacgggcctttcggcaatggattactcagttgcgccacatctttcacttcaaaagtgataagctccccgataccggcgcgacgggcgttgctgcgcgcccgctcaatgacgcgcgcatcgctgtcggaaccgtagaaatgagaggaatactccgccagccccttacgcgcccgggtctgcgcttcggctttcacttcctgccagatagcctcgtcatgctgcgcccagccgctaaatccccagtgaccacgatgcaggcccggcgcgcgatcggtcgcccacatcgcggcctcaatcaacagtgtccccgaaccacacatagggtcgagcagcggcgtacctggttgccagccggaacgcataacaatcgctgccgccagcgtctctttaattggcgccagcccggtgcgatcgcgataaccgcgcaggtgcaggccatcaccactgagatccagcgcaatgctggccgtttctttattcagccagacgttaatacggaggtccggcgattcgcggtccacatttggacgcggaagatttttccgcgtaaacgcatcgacaatcgcgtctttaactttcatcgcgccatactgactattacggatggtgtcgttcaggccgctgaaatgcaccgcaaacgtcgcgccaggattaaaaatctctgtccagtttatcgcctgaacgccgaagtaaagatcgagatcgctgtagaccttgcactcacccatcggcaggataatacgcgaggccaggcggctccacatcaggctctggtaaataagccgcgtgtcgccctgaaaatggaccccaccctgaacaacctgacaccctacggcgcccagtttttccagttcaatttttaacagctcttccagcccgcgggccgtactggcaaacagagaattcatattgtcacttttacgctaagaaaattgttgcgcattatagctaatctcacgcccatgtcataaagttgaaggcttattttcatttgagggactgtacggtggcgacgttatcacggctctttattcatccggtcaaatccatgcgcggcattggcctgactcatgcgctggcagatatcagcggcctggcttttgatcgcatcttcatggtaaccgagtctgacggcacatttattaccgcccgccagtttccacaaatggtacgttttaccccctctcccttacacgacggcctccatttgaccgcgccagacggcagcagcgcgctggttcgctttacggatttcaccccgcaggatgcgccgaccgaggtctggggaaaccattttaccgctcgcgtcgccccgacggcgattaatcaatggttgagcggctttttctcccgcgatgtccagttgtgctgggttgggccgcagttgacgcgccgggttaaacggcataacgcggtgccgctgggatttgccgatggctacccgtatttattgaccaacgaagcctcactgcgcgatctgcaacagcgttgtccggcaggcgtacaaatggaacaatttcgcccaaacttagtggtttccggcgtagcggcctgggaggaagatagctggaaagtgcttcgcattggcgatgtgatttttgacgtcgtgaagccctgtagtcgctgtatttttacgaccgtcagccctgaaaaggggcaaaaacatccttccggcgaaccgctggcgacactgcaagcttttcgtaccgcccaggacaatggcgatgtggatttcggtcagaatctgattgcccgcaatagcggcgtcattcgcgtcggcgatgaggtggagatactggcgacagcgccggcaaaagcttatggcgccacaacgctcgacgacagcgttacgccagagaaacacccggacgggagtgtaaccatcgactggcaggggcaaaccttctgcgggaataatcaacaggtgctactggaacagttggagaatcagggaattcgtattccgtattcttgccgggctggtatctgtggttgctgccggatacgtttgctggaaggcgaagtaagtccgctgaaaaaatcggctatgggtgacgatggtacgattctgagctgtagctgcgtgcctaagaccgcgttacgactggaaaattaaaccgcttgttcaaggctgaaactgtgacagtgaacctgcggtttcagcctgtcgttcataattttaatcgcatcgccaagctgcatggttcggcctgctatcaccacgcctggctgtgccagcagacacaacgcggcattttctcccggctcaacgaccagcaaattaacctgttccgccgtatcgcttaaccagacgcttgcggcatcacccgtgcccggggtccacatttcgccatgcgccacaaaatgccagcttttcggcatctgcggtttgagatagcgaatcgccaccagcgcattcaataccagctccgcgcgttgctctttggttaattcgaaatcccggcatttttcttcaaaggaaaaatagagcgcggcatcatccacacaaaaaccggtcgggcaaaacgcgtccggcgtaagcattttacgagagaagcgcgagcgaaaaagcataccattggcgagatcgagcatcatacgatcgtgctcttcatcataataccagcgccagttatcgtcaggtttaattcgcatcacctctctcccgcttttaagcaactcgtaacagcattgtccttttgccgcttcgtttattaccccaataataaaagcctaaaatgtctaaataagcaacagtggagaaatataaaacaaccagtgccggaaataaagccctggttgtctgataaagggtaaagtttagatgtgcgttacgatttctttaatcaatggcgggcctttaaaaataaagccggaataaatttgtaccagcgtagctcctgccgctatcttctcgcgcgcggcgataactgagtcaatgccgccgacgccgataataggcaattgtccttttaactccagggataaacggcgaataatttctgtgctttttaattgtaatggccggccacttaatccccccgtttgctggcaatttttcattccttgtaccagagaacgatcgagggtggtatttgtcgcaatcaccccatcaatattatgacgaagcaggctatcggcaacctggatcaattcttcttcacaaagatccggcgcgatctttactgccaccggcacatatttatggtggatcacctgaagatcgttttgcttatttttaatggcagttaacagatcgtccagcgcatcgccatactggagcgtacgtaaccctggcgtattcggcgaagaaatattaatggcgatataacccgcataagcatagactttttccatacaaatcaggtagtcatctttgccattttcgacaggcgtatctttatttttaccgatgttaattcccagaataccatcaaaatgggcttttttaacattctcgaccaggttatcgacgcccagattattaaagcccatccgattgattagaccttcagcatccaccagacgaaaaagacgtggcttatcgttacccggctgtgggcgcggcgtcacggtgccgatttccagggagccaaaccccatcgcgcctaatgcgtcgatgcactccccgtctttatccagaccggcagccagccccagtggatttttaaaggtaagtcccatgcaggtaaccggctttgtcggtactttctggcgcaccagcgcttccagcggcgtacctgtaatgcggcgtaattgttgaaatgtaaattcatgagcgcgctctggatcgagctggaaaagggctttacgaacgaagggatagtacatgaactctcctggattcccggtgtgcaaaccgggggcgtattatgggcgataacaaagcaaaagggaattgacctatggcaataaatagcaatcgttttccttcattctcacttcacgtttcgccaggaagcgtcatcatccggcaaaaaaatacccggcagcgctaacgcttaccgggcatgttttacctctttataacggatactgtcaggctaacgctttagttatcttctcgtacagatcgccggaaagattctccagtccttttaactgctccagcgccgcgcgcattttctcctgacgcttatcatcataacgtttcagacgaatcagcggttcaatgaggcgagatgctacctgcgggttacggctattcagatcggtcagcatctcgaccaggaactggtatccgctaccgtcttgcgcatggaacgccgccgggttgctgccagcaaacgcgccaattaatgaacggatgcggttcgggttgctcatactgaaagaacggtgtttgagcaggctgcgtacggtttccagtacattttccgccgggcttgtggattgcaggataaaccatttatccattaccaggccgtcctgatgccacttatcgtcatactcctgcatcagcgtatcgcggcacggcaactgcgccgccactgcagcagacagggccgccagcgcatcggtcatattattggcgtcgcgatactgtttgctgaccagcgtattagccagctccgtctcgccgaacgtcaggaagcgcaggcaagcattgcgcagcgtgcgcttaccgatatcgccgtgatcaacacgatactcatccagatgattggcgttatagatagccaggaactcatccgccagttctgccgccagcgtacgcgttagcgcttcacgaacttgcgcaatggcgatcgggtcaatgacctcaaacagctccgcaatttcattggccgaaggcagcgttaaaatttctgcggccaacgccggatcgattttctcatccaacagtactgcacggaacgcatcagcgacatgcaccggaagcgatagcggttgcccctgctgatgacgcgccacattcagtttaatgtatgtggccagcaggctttgcgccgcatcccaacgggagaaatcattgcgcgcatggcgcatcaggaacgtcaactgctgatcgctccatttatattccagcttcaccggcgctgaaaactcgcacagcaaggccggaacaggctggaagtagacattatcgaaggtaaatgtctgctccgcctgcgtgacgttcagcacggcattgaccgggtgaccgcctttttgcaacggaatgacgttgccttcgttatcgtacagttcgatggcgaatggaatatgcagcggctgcttctccgcctgatccgccgtcgccggagtgcgctggctgatggtcaacgtgtactgctcggtttccggattataatcatcttttaccgttacaatcggcgtgccggactgactgtaccagcggcggaaatgggacaaatcgacattagaagcatcttccatcgcctgtacgaagtcatcacacgtcgcggcgctgccgtcatggcgctcaaaataaagctgcatccccttctggaaattttcctcacccagcaacgtgtggatcatgcgaatgacttccgcacccttttcataaacggtgagggtgtagaagttattcatttcgattactttatccgggcggataggatgcgccatcgggctggcgtcttccgcgaattgtaaaccgcgcatggtacgcacgttactgatgcggttcaccgcgcgtgaccccaaatcagagctaaactcctgatcgcggaacacggtgagcccctctttcaggctcaactggaaccagtcgcggcaggtgacgcggttgccggtccagttgtggaaatactcatggcctatcacgcgctcaatatcgagataatctttatccgtcgcggtatcggttcgcgccagcacgtatttggagttaaagatattgagacctttattctccatcgcgcccatattaaagaaatccaccgcgacaatcatatagatgtcgaggtcatattcgagcccaaaacgcgtttcatcccatttcatggaatttttcagcgaggtcattgcccacggcgcgcgatccagattgccacggtcaacgtacagttctaatgcgacttcacgcccggagcgggtggtaaaggtatcgcgcagcacgtcaaaatcaccggccaccagcgcaaacagataacacggtttcgggaacggatcttgccactgaacccagtgacggccattctccagttcaccctgcgcaacacggttgccattggaaagcaggaacggatatttgcttttatcggcaataattttggtggtaaatcgcgccagtacgtccgggcggtcaagataccaggtaatatggcggaagccctccgcttcacactgggtacagagcgcatcgccggactggtacaatccttccagcgccgtattcgccgccggacttatctcgttgacaatgcgtaacgtaaaacgctctggcaggtcgctgatgataagcgcgccctcttcttccttatatgctgtccacggcgcatcgttgacgtggatagataccagcgttaaatcttccccatcaaggcgaagaggcgcatcaggcgcgccatgacgaacagcctggcttattgcggtgaccacggttttttcggcatcgaggtcaaaggtcaattcaatatcagtaatctggtaatccggcgcgcgatagtcatggcggtatttggcttgtggctgttgtgtcataaaaaacctttcgcatctttgtgtagagtgtcgactccagtctattcctgttgcgcaaatcgcgctacgcagaatgttcatcttttcaggcacaaacggcctatttgctacatttttataatatgtactcatagtttttaaaatcgataaagatcgtccaggagcgctttaaacaagggatgagcgagatcgagataaagctttattaacgaactttaacgaacttcacagaccacttttgccccatccatgccccacacataattttagtcaacgccagaccccatcagccctgcagggcaaatcgataacaaacacgcccgcagtatgttccccaaaatttaaaaacaagtggttcatgccttgacagacaaaaccgccaaagcaaaatactgtatataaaaacagtggctggcgaagcacgtatgttcgtagaactggtttatgacaagcgtaatgttgaaggactcgaaggggccagcgagatcattctggccgaactgacgaagcggatgcaccagattttccctgatgccgaagtgagggtgaagccgatgcaggcaaactgcttgaatagtgataccaacaaaagcgatcgcgaaaagttaaacaggtggcttggctggtttcagattacgcgggtaggatcagatcactccaaataccgacgacatagaattaggaattcagtgatgaatcaatgatggcaatacactgttcagaatgccatcgcgtatatgcgagcacagtgcccgtattagagaacatcggagacgggaagtaaagtatcggggtctggtagaccaggctgatgcaacgaagccagcctggccagtcatctgtaattggttgagagggcggagtcctgcgtaccatgagtaagataatcgtctaaaaccgtaaatttttaatggaataagtcttaatctgtacaaaggcatattgcttttgatatataaaccccctcaatatagacgtgcatttatatcaatgattatttaaaggagtagtgaagtatgttcttaacatttcctaatgtagcaataactcgagataacaggatagacaaattatctgaaaatgatttagaactcattcgtgatacggctatacaaaatggcggaagaaagatacaggtacaattacgtgatttattatatgaagtaagtaatcgtgctgttgaaggtgataataatacattcaaagttagtttttctactacagaccgagccatgtttagggaacgtcatattgaatggcagggaaacgctataaggttagaacgacaattaaatactggactgaatgtgtcgcgtggaaattttttaaatatgtcgaccacatcattttccaataacagtcaggagttagcagcccacagttcaccaggagcacctgctatttttgatacatctaataaacaacaattagtggataagattgatttatgcagtttctcaccaaatgttgatgaactttcatgtacggaagacaacttaacatgcccggtaatgttagttgttcctgaaaaaggcgtttttgtaaaaactgggccagagtcaaacatatgccaattatttgatgaaacagcacttatccaacttattattgacggtgccacacatcctgttagtagggctccattatcactagatatgataataaataaaaatgaatgttattttgacactaccaaaggtaattttataatcccataatccaaatattactaatacctttatatatagagcaactctattagagttaggctattttctaatcactccggcagtctatgtttcgatgttgattgctggagatttaccttccctatcatcacctcctggcttcacttcatgatgctttccggaacctttctgtacagcgtcgacagtctcacatcataaataatcgctacctgctgtcgcggtacccctgccctcgctgcgcccattgctccggggtgagctttggacgtctgccaccaatacgcccctgctcccttgccgctgccagcccggcgcgggttctttccacaatcagtaccctctccatggtaaaccgggtggatacctcaaattctgactggccggataagccagccagtcagtagtcgttaccgtgacaatttaattatccatatatcacaaaatcacttgcttacgcggtaattaatccatttggttaataaaaagttatttcgtttaccagcatattttatcccatggtagttctgggattaatgtatctggcggccagattttacaccacggaaacgaaatacctgggaatcctttattaccgctttcagtggccattgcagatgaagaaaatgttatgactgatatggcaaaaaccagcgctaacaatacactgttaagtttattcataatatcactcacataattgatagctatgcttcatccttaacttttaccgcaatccttttatcaggataaagcagaaaagaaagttttccttgaatatctcttgattgttaagtaaatatttagtttaaaagtaaataataagtacagtagttttttcttttctaaagaaaatttacttatatcttagtgacttcgtacagatacctgaaccgaattaacacctaaaaactagcaagtcagtagtagtcgttattgtggtaattcaggccacctgatttccgtgaaggtggctgagtctttcacgccgctcaaatccagcgttttaagcgccctgatatacgccatccatttagtcaggctgtccttatcgtcgtcaccgatttcacccaacgccagttcggttcgccagtcggcaatggtgctgttagcggcatccagtagtttctgtcgggtggtttcggccttagcctgatagtcaacgggaacagccagaacagtgccgttcgaatatttccagtcgccatagatattaaatccggctggtagtttattgacctcaacaactgaaaagccagccggatagagtcgcgacacatcttctgatacggaacggattatattttcagaatcaatgcacaacttatattttttcgtgaatttactcagcgactcataaaaatcctgaccatcttcactacgaaaatacagaaagctgttatcataatccgggtcatcaggaatgtatctggttacgttttttaattccattatattcacctaaattatccattaattgtacgccagccattacccacccacatttgtagcggtctatacgcaaatgtcacaccgtatgctgttgttgggtcatgtctggcctgtgttaaaaagcaaccagcaggcgcttctgctggtccatattcatctactttgccaggccatacaggagcaccgcgctggatattttggacataacgattatctgattcgccttttgtatatacgtttcctgatgttaaataacgggcgtcgaaattaccgtaattatccggaataacttgtccattaacaacaaactgaatactgccatcggtattacgctggctgtataaatgccatccctggtcgtcatccagctcaataaccgttggtcgatttccgtcaccccacaaatgaaattgagcattcagcacggagttatttgagctagtcatggtcattcgtttggcatcgcctgcgcgaatggctcccagaacctgcatttcaccgggagcgacacgaacggtgtgctggctattcgcaaacgtatccagtatcccatcgccgttctgtttaaaaccagtgtcattatcaccaagaacgatcgaattgccgcccagcgcattatcagtaccaatgcttagcggaccgttaagacgccctccggtaatcggcaatgcacccacatcactggctgacggtttatttgcggtgttgtagtcaataacccacgggcgactggtattcggtacagttccccagtcctggcgctttgcgttcgcgccaatatgggcataataatgctgaaaccagacgtctccgattttctcaacaaacagatatccatagctgtacaacttgctgccacccggataggtgggaaaatcaacgaccgtatcagaattcgacaccgccaccttccaccatccgggtgcattagctgatgccattgtgccgttatcggtaatttctccaacagcatcggcggaaatggcccccacatctgacgcccacaaagtgatatcaccggtcagtggtttactgttaacccgccgtgtcgccgggacggcattttttgccagatttatcgtttcgcctaaaccgaggtatgtgagaatatccgcaatactggcttttccgatgatgtcgcgcccaacagaagtaagatctgtctgtccggctgtatcattccccgtgaaatacggaagtttatctgcaccagtagccagaccagcgagcgccgtcagcgtggcatcaagagtctgaaaatccttaccgaacgcagcggacattttggcgataaagccgctcaggtcaccatcatcgagtacatcctttccgctcttactggctgtgtactgtgccagtgctgcagcgatgaagctcgcctgacgcagcgctttatttacctgtgcacttgatgccttgcccgcagtaaaaccagacaggagcgccggcagcgcttcccagtcaggctgtgatgtaacattagcacccttacccgtcgcaaacggtttaaaatcatttttagccatcagagtaatgtcccccatgaaccggcatcaaacccgctgatatattcgttatccatatcaaacccaaaaaacctgtttccttcagaaggcgtttccaccgaaggtatttcaatacttccgccccatacaccagcggcctttaccgtcagatacccttgtcgtatcgcagcaataagttcgagagagaccgatgaaatatctgtttcaggaaaaacccagatacctatggtcatatcctggttatcgacgatctgcatcttcagaccggacccgtccagtgcggcgtcaagaatgggaggcagggagtcgtttcttccgtcccagttgttaattgctatcttcgtttttagaacgatgcgataggtttcatcgctcagcgaggtataacccgaatccggatcatatggcccctgccagacgccctggtcatatccaagtccgtcagtgtcccaactgaaatagacaccgcttattggctggcttacaacacggcttaaccctatccactggccgagaatatcgagttgtattcctgtcgcataatcaatatcaaaagcgcttattagcccatttattgcggctgaggtttcagctaacggcctggtcactaaatcgatgtgttcaacgaatttaggttttgtcgcatgatagttagtaattaagtccgtatatttgctcatgctgccaccgtaataatgatattttccggcttacaggaggcagattcgtcgtaagcaatattaatattcgccgcatcaacggtttcaggagatttgccgatcagcaactcctgaatatcgtaatagcgcgcattaccaccactgacgaccccaaggttagcaggagaataaatccggctcagcagtacctggtcaccaatcatcagtctgttaatgtaatccgcaacagcctgctgaatctgcacacctatctgagaggtgtacccggcaaaaacttttaaggtgatttttccgtaaacagggacatcagttggtcgcgaaaaactgattatgtgaggattaccatatttatccggtacggttacggatgtttttccccaggtccggaccccctgccctttatttccccggatggtcctcgctatttcggttacatcgccaccatcaacaatggccgagatggaatgcggaggaagcccgttaccgtcagtctttcctgtatcattttcatagagcttgtggcgcgtcacaccagcaatattagcgatcgccccgtccacgccttcaaatggtgtgatggatggtatcgcgacactctgcccctgcctgatgcgcagttctgcgtccgtttctgcaggtgcgccaacggtggccgctgccgggttggttactgacgtccagccacgggtcggtgtattgatagtggtaatcgtcccggcaggagctgcaaccgctccgcttttggaacaaattgcagttgccgtcacggtgccatcaacaccaatcaccactgaatccggaagacgccagatcacgttattggtgtctttcacggtgccgttcgtaatggttgttcctgcggtgccagtgagcagtaaatccacggtagagttcgttgcacctttgcgcgcgataccgttaatttttacgttactggtcagcgctgcgccgtaacctgtagcaggtgagaagcagttatagacggaaatggctgtgttattggcatcgtgaatagctagcgccaccagcgccaccatctggccgtctttgctgtccggctccagataagcgtcactaccataaatctgctggaaatagctcgtcagggtatcgagtatcgtctggtaatcaggcgcactgatcccctcagcggttaccgttgccgataagccgagtgtgtccaaattgagggccatttatgcctcgctggttactgtcgttgttccgtagatagtgtcgatttcagcgaaaaactggacgcggcgcgtcgtcgtgttcactgtggtattgaaagagaggatggatttcacgccccgcgtttcgaggatgcgcttgcggatcgccagattgtaggtttccggcttttgcttaccgagcacagactgaatccacggtgttccctctgtcttatcgaggaaccactgcccgtaccacaatgcaaatcgtgtttttaccgcctgcgcgacagcttctggcgagttaatcagccaggtatcatcgccactaccaaaagtgtaatcaccttcggtatcttcgcgtcggtatcgcatgtctgacctccttattcaccaccatcggacggcaccaatcaggctcgaaagcccgaaaaggaaaaatacaatccatataagcaggaatttccagttgggtaatttttcgcccataactcgcaactccattatcagtttgctaaaatcaatcacatgttctcccttgccatcctcaaggtgtagaaagtaaaaagccccgaagtgttagcgcacccggggcttttgtctggttggtagtttttaattcggcgcgccagtattcccgccacccgtctgaacgccgctatgagtgtgcgtcatcaggctcttaccgcccgccttcacatcgtttgtcaccgtgacaggaccgagcatcgttgcgctaccgccgccctcacccatcccctgcgacagattgccgttaatggttacgtcaccgtttagcgtaatgatgggtgatgtgatcgtggttccgccttctgcagtagccgtcagcgcgccgggggttttaacagtaacgttatggcctgcggccacttccacaaaagcagccccatcatcggtacgcaattgtgcggcgctggtgctgattccgcttattttctgcgcctgcgactgcggcccgacgatacagaacgcatccgataaatcatgcacccgatcgtcgacaggctcctgtaccccgccgttctgccaccagaaatcgatgcagcgatcggcaaaaatcaccagacactcatcaccagctttaaccgggaacgttagcgtgcagccaccgccgcgaggaaataccaccggcacatccaccagcagcggtaatgtcgtcgactggctaacgccattcgaatccggctcatagcctttgatagcgggttgaacaactgcggttacggtgtcgggatcaaatgactggacgatgccaggcattgaaactcgcagtgcagacatgacagaaccaacaagccttgtatcagcctgttctttactgccgagttgagaggaaagtgaaactggcatattttctccagacataaaaaaacccgctcatcggcgggcttggtatggtagtcatagcttatgctgttaacgagtcgtcggggttattcatcattcggtccactagagcatctatctcttcagcatcttgtaaggcactaattgccgtaattcgattaattttgcgttcaagtctgtaatcagcatttacgcgctgagcatgtaacatctttaacttaatgccaattttacggactttatcaacatctacgccgttaactttagcagcctcaccgttacaaaaagctgtatagagtcgcatgtgagaaccgccaggtaatctctcaccatcagtatcatgggtaggcgtcagattgttagtgattctgagggctgaatgatacatgccgtagtatgacctgctgatagcattacgtgtccattgctcaccattgtgctgcaatgattctctggctaattcgagaaaacaattatgcataacaggcattagaagtctcctgcctggaaacaaccaacacactctgaattttccaaaccagcagcgatgagttcattggcaaggtcgttattcacttttgacaaaagtgctgggtcgtcagttttaatttctacgaaaaatgtgttcagctcattcatgacataaaaagcatgcgcaccagccagacgtaaacgatacttttcagcaatagtcatcatcaattggccgatcgccttaaggtcatgagaatgattctcatgatcgataagataatcaagcgactcattacacttgagcaaatcgtctgccttagcaacttccatcgcattaagcataggcattacctttttcagcaaatctaaatccacccaatacgcagcatttatagccacttcagaaagaattcgaggattacgcgagttgatcgctctcttaataatctcgtattgcttaacgtgataccccttgtttctcaacgcaatcgtatagttacaaaacgaaacagaatcgtccggggctatcgccaatgacttttcacaaagggcacatccctcttcaacttcgcctaaaacaagcttagctaatccctcgatagaaagcccttgataatattcaggaacattcctggcgtcacgaatgacggcatgaatttcaaactcactgagtaggttttctccctgagtgagtgagggaccaaggatctctaaaagctctccggatttaggctgcgctaaactcatttagttgtaattcctgactgggtgacatcaaagttgatggcaaaacgccttcaaaagtatctgcagtgtaatgggtaaagttggaaaacgacagcacgatgcgcacattttgctgattttcagaaagtttggttagctagaaatgtcaatcgatttagtttcaccgaggcaccttcttacaaggaaaagcgcgttcacttcaccttccggcagtcatacgtccagaactctcgcggctcgtccatatttttgcgaataacttcaacattgaggatcggcttgccatttctggccacaaagtccatccctaaccaacgtccattacccggaaccatccattggatgttcacattgtcataatcccctttttgtttgagaaaggtgattttctgtgtctccggtttctgtccattaatccttgcaagtccgtcttgcgctttccagttgatcgtgaatggtccgcacccggtatcagcaaaggaagtgaaggagatacagacaagtaaagctgccaacaatagtcttttcatgtgtatttcgccgcatcaatccctttcgagttaagcaattctttgccatctttagccaggcaaagcaggtccatataccacgcctgcccgcgagtgtcgccagtataatcgatgctgcccacaatgtaatcaccgtcagtattaatgctggcaggctgtgacatgccgggcaggccgttaacgtagagattaccgtcgctttccgattcatccagccgtgctggagattgcgctatctggtcattactcaaagaggtccggtagacagatgcctgatccagacgaataagcccacccagcttaatgtttggattaatcaggcacctgacgtttacgcctgcacccattgtttgctgaggcctaccgattagccctgtattggcattcagcaccgtagcgacaccgatatagttatcttccggcacaatgttgacctgattgttctcataccaccagtaagcgttacactgtccggcgatatgattcatcagcctggctgtgctctgatagacaacccgcccacgggggaagaccgtctcaggcatgtcaggaactgcacctgactcgataccataaggcccgaatgatttcatgcccaggctgaaaagatcactgtacttccagccggcagccactgtggttttcacactggcgttcaggtggccttcccaactgtcgatacactgcaacatgatccaactgtctgtcgcattatctttcccggtgacagtaaaacggatatctccgttgaatatcataccaacgttttcatcgggataattacccgttgcatccggttgtcccttatatccggctataacctgtatacgcgagaattccttctgcataatccggttctgagtggtaggggacaggttataaaccttaaaatttccaacgaatccattaaatatggtcgcaggcattttctgaatattgaaagtgactttaagctcagaaatttttatcccgtcgcccttatcgtcaaccagcaataattcaaagtgacgcatccagttttttgacattgttactccgtgaagacatagaggtgtgagaacgttccgagatcgaattgcgtcgggttttcctgtcctgccacgtcgcagagtaccaccagcgaaaacccgagattcatatatcgatactgcgccagcaggtcagcccccgtaatcatcggcatacctgagataatggcggaaccattgctgtcagcaagatccagaacccagtactctccgcgccagatgacagacaggtgataaaccgtaccgttaattgtggtggcaaaagtctgattatcagcgaccagtgggatttctacggcctccatgaatcaccttcccagaaataaattgctcagatacccatcgacagtggtgacacctttttgcgccatctgtggcagcgatttcagaatggaattattcggcggtaccgttgttttggtacctgtattctgtacagcagacgtccctactccctcggtcatattgtttttcgaggcaaccctgattgactgcgtggaggtaataatcacctccctgagggtaagggtcgccagaagcacattctcactgctcttgtcagtcgtcacctccagcgtttttatcaacatattgttgtaaatacgcttgccggttgtcacatcgaaaggaatacgatcccgctgcaggttaagcagctcctgatacagttctttcgggctcagccccagtgaaagaccaatagcggaagtatcagcaaaatcaagcagcgatccgcctccggaaaatccggtttccatcacaacttctgaagggcgcctgaatgcgtgttctgatatgtaaccagcgccctcaccactggcaccagcattcgtgggttgttcaaccggatgttccgtaatttccagagcgtcagtatgcttttcggtaataaccacatcaggaataattattcctatcgagcgggttcgctgctgcagcaaaacagataaaaaatccattacgcaggtcctttcaattgctgtaccgccctggcattgacagcaccctgcttgtcagcgatcagattagccgcttcctgaggattgttcacgccgtggacatttataacagtctgctggttaaggctaccaccagcggcctgatacgccagcgggctgttccagtttgaatacccttctttgcgcgccatcgactgcatcagcgcggccatagtttccgggttggcgaggttcaacacagtgttcggtgaaacgcccatccattttgcaacatcctgcgcatactttttcgggtcgttgttgtcaccagccggcgcccaggtactgacaatatcctgaatggtctgtaatgcccgcccggttgttttccctgtaaagtagcgcataagctggtttttcatcgcctcccagccctgaagggcggactcgaagaaccggaagccgttaccgcccaccgggcgaatgttacccggattgttgttcctgtcggctaaagtgcgctttgcggattgtgcatgttgtacaggttctgctccaggaatatccggctgaatattagcgcctttgacggtgtggggattgcggccaaaatcggtatcaatccccagtgcacgcattccatcgccaatgttttgtttggcataatcgatagacgactgcgcactggcgacgatattctcccgatcgtcatacaggtaagccgcgtaggccatccagccttttaaccacggcggcatcggtatacctgccagtctggcaaatgcgcccgttaccttgctaatccacgcaccggcgataaaggtcgccagcagctccagtgacgttttccagccgccaatagagtccttaagttcgagcaggtgatcacggagccagaccatcgcatccttcgctttgtctatcgctggctgccatttttcccagtcaataagactgttaccgccttctttccatgttttgtagtcttcccacaagagaccgaacgccacgatcagaccagtaatcagccctacaggcgacatccagaaagtagagttaagtatccgcatggcgacaaccagaccaccgataacctctatcagggttttcgtttctttatccagttttccccaccagtcgataatatcccctacaccttcaacaattcgaaacgccacgcgaccgatgatatccccgagcgtcagaataccttttatggctttcgtcagggtctgctcgatgcgcgggaagttatccaggatgtggcggcgcagcgtgtccagcgaacccgccagaccaccagcaagattagagccgatcttgtcacgggccaagcctgccatcgcgccgaactcgcgcagggaggtcatgaacctgttggagcttttggccgcctcgtcagcattgaaaccgatggcctttgccatcgcgctgtactggccggagaatccccctaaaccccggcgcatcgccataagggtattttcatcaatgcccagcatctgcgcatactggttagcccggtaatacggcatgctgctgagctcctggccgacgcccgtaaaaatggcggccatatcgcgcatattcccgctggcgtcccgggtctgtacgcccaggcggttcagaaagccttccgcgccgggattattacgcacaaaccgggagaggctttccagcgaagtccgcgccgcgtccacactaccgcccacctgcgaaactgcgtagccaatcgactgaatcccctgaaccgtcgcgccggtgcgttgagatgcccagtagagattatccagaccggaggcaattttcgccgtaaacgcaacaacggacagcgccgcaccttccaccgccagccctgtttttatggcatttgcggtgacgccagcaagaacagattcaaatttctcgtatccggcttcatcaatgccaaatccaagggagacgagaaaatctttaatagtctcagcgttcattaacctctctccatttatctacccgagcatcgttatcctcgcgcatgtcgaggtagtcattgagaagcgcgatgcggcagagatctaccgcgccgctgttaaggtctttctggtcaatatggaaggcgagaaccgggcgaagaataaaatcttcaccgcccggcaggctgttgaaggttattccgctggcggggtgggcgtcccgttggtagggagtccttgcaaaaaatttcccagagaatcggcgaccacccgcgccaccagctgcagcatggtcagcaggtcgatatcgtcaaacatcaactgaccgctgttaaacaccggggcccatccccccatatgtttgcgtgataccacagccaggcaaggatgaataatcgcgttggtatcttcttcggtcagggaagacagttcctcagcgatacgcggcagcagggtttcaaacaccggcttaagcgcatcaaacttagcgctgtcgattttgccatccgcaggcagaagggagcgaatgcccccgaaatctgacatcatgcccgccagcaccggcagcaatttacgggtgactttcagctggtcaaaaacgctgagtttcgccacgcgataatcgtggcctttgactgaacattccatctgttaaaactctccgagtacctggtcgattttgccgcagtcaaatacccagggcatcgtattaccggctttcgcgttggcgttatccggctgtttctggaaggccacactgcgcgccgtgatgatgtctccgctcaccttatttcggatcacaatgacgttgtttccccaggttcctgaggactgactctgtgcgttatacgccagcgacagttttttgtttgtcggcgaggtcttcagcagattgacagttaccgtaccgcttttatccgcgtgcaggctgtgcatcacttcgccgtcagcaccgatggtcatggtgtttttggggccgcccattgcaacggtgatcccctcctctgaactggcggaaccgtagcccaggtcaatctcgccagtcgggccagaaatggacgcggtgacatccataaaagaataagtagccattcattttccccttagcgaacgacgttgatctgtacgtcagcgaaatgcactgcgccagccagcttacaggaaacctgaataaccggtgccttacgtgcttcacggtctgcctgcgcctgctcggaaatcggctgcgcgtagacgtaatacccttttgtcagcgcgtctccggaatccagctgcccgattgggccaccgttccatacgccagcagccaccagcccgttcgtcacggactgatccatagactgctcaacattggacagaagacgtgtaacacccgcatcggtctgaggcactttggttgtactggtgtacagcaggttatacaggttggtctgaacgtagttctgcagccagtcgagcccgtggcgctcatcaaagaaatcaccgctggacatgacgccctgctgcaggattgccgtatcgttctggtagtacacaaacacgttgcagttcttggcatccagcgccgccgcctgatcagtcgtcagggtttcgtaagtgatccccggctcctgtttaaatttcagggtaatggtggtattgctgccgttgaaattcaccgtaaacgcgcggccaaacgcggacagcgcagcgtacttgctgctggaagaatactgtacgaacgtgcgcccgtattttgccgccttcagcttgtaggacagatccccggttgaagtggcgtcaaaggtggcgggatcgctggtggtaattgccagaatgcggctgacgcccgaagcttctacggctgcagcaaccttcagccagtcgtcatctgcaatatcctctttgtctgcaataccgagaccataccagttggtgtagcccattacggcgttaaccgcatccatcagcttttcagcagcacccgcctcacccgttgccagtgttttagcccagcgacctacatacacctctttaggtcgtggtgactgggagaaatagactgttgctgcttcatattcggggctgtccacgccgaaatcagatccgatgtcctcctttgaggagtagaggcgaagacgctctttcaccggaatgaccgtggatgtcccgagaataagcagtgaaccaaaatttcgaccagtagccgcgcgcggcccaatgatcacgtcgacattaacgacgtttgatacaggtaatccctgcggcataatttaatctccgaagaatgaaactggtgcatccaccagcgatttaatgccgtactcgcgcaccaccttgcgacgaaggcgcacagtaatgtcgtaacggcgaacccactgctggttgataagttccgggaaaggggtcagaccggtgtagtcccccatggacaggccaagcgcgttcagttcggcgttgttttgcgcaacagaaataccatcgcgaaaacgtgacgcaaacgtcatgcccgccgggccataaaatgacgccatgcactcaaaggtttcatgtcgccagagctgagcgccctcttcagtctggttagtgaatgcgggactgttatctatgggccatccggtaacgccgaacgcgcaccagttcgtttcagctggcagcagtggcggctgatctttctgccatcgggggcgaaccattccagtcggcaaaccggaaacgttgcgtacccactggcttaacagcctgtcgagcgcctcgtcataatccggatcgccgctgacaggtgtaagccatcccggctccgtactggaattattgctcaacgggaaatcctccatcgaacggcagcagctcgcaatgcgcctgtacaaagccggcgccatatgcggtgtacgggtcgacgaatgtcacacgataatcacggttctgatacgtcacgatatcggcatcacggccagtctgcccctgcgtgagtcgctcagtcgtcacgataaggattgctccactgataacctgcccggactgcatgcggcggttttccagtgaacggtcaacggtaacaaccccggcaaactgcgttttaacttcgctgtcgctaccaatcccgtcttcgtccactgtctgtacccgacgcgttacccaaaggttgaagtcacaaaaatccgggtcgaaaagaacatcggttacatcaagagtcggcatctttatccctcactacatgggttattgaggcgagatatttgccagtatcgtaaagaggcttagccaaagtggtgcccggagattcaccagcagcacgccgcgcaagttccgctttcgcacctttacgcccacggcgcgcacgcgcttcaacggtgctatctgcaagcggagtaaaattggcagctttgatgtgatttttcacccctcttgcagccactgtacctgcgcggttgagtgctctttccgctcccgccgcattaccatcaagcgcagcctgtgccgcagctttaagctgtggcatcgtctggtcttcaactgatttaacgccgggtacaagatgcggacgtggtgggatgttttgtgcaggtgaaccgtattcgttgatatacccaatcccggcattaccgaacgacacatcatcccgatcgctgtcttccgcaggtataccgaccagcacatcctttttggttagcgactttagcgcatccagtattgcctgagcgttatcaaccctcgttgttacaccgcttttgaaactcatagctggcgtccccctgcaccgaacatcgtgatcagctgataaaattcagcgccataccgggtgttattccagaagcctgcgtcagggtttagcgtcgcgctggtgtcatagctgacgcttaccttgtcaacggacttggaggactgaacaccattggttgaaccgcccggaccgccaaccagcatcgcccggctatctgccgcccagagcgtcatatagtgcgcaacgaacaactcggcaaagtacggaaacaactttttgccggtgacgttttcgctcagtagttcatcggccagattcagacggaactcgatttgtgcttcgggatatctggcagggtcagcaaactgcgggaagtcgcggcgaaaatcacttactgttggcaggctttgattctttggcatctttcgccccattaccgccagtccgggcggaagtaatctgcgcctgcaggctgtcgttctgctcctgcagcttgagcagagcgtctttcagatcggcaatcagtttatctttatcggcaatctgcgcctgaaggctgtcaataacgggttgctggtcatcagtttcattcgatccgctttcggaaagctcagcgtgcgcccgggtaaaccagtgcgacgcgacctcttctggtacgttatgccgtccccggccaaactcctgttttgactgatcaccgagcgtcagcgtaaacggggtgtgaacatggatggtaaccagcttttctttcgccatttttagtttccttctggcccctttcggggccattctggttatcagataccgtccacgtaggacagggtttctttgtacactggctcaaccgcaccgagcttgccgtagtaggtcgcaatctggtacagaccacgatactgaacaggaacgctttgcagcggaaccagtggatagcggacgtatttcttatcgttggtgtaggcgaccatacggtctttaccgccaaccccgcgccctttcagccatttgaccgctttgatttccagcggaacgccattctggtggaaagcgatagtgttcacagccagataagtcagcagtgactggttacccgcttcggaaaccttacggctcgccagcaatgaatactgctctggcggaatgcgcagatcagaaggcacgacggaataaccggatgctgcccaggcattcgacagaatgctgtttacgctgtcgaggatctcatcgttggtggagttagcccaggtcttcgttgcgttgttcagcgtcacaccaacgagattcgtcagacctttcaaaccaagcgcttcgtctccgacgtaaacctgttcgtcgttatccatctgccatttaagctgcatcccgtcgtacttctgagtgtcgatcggacggcctacctgctgtgccgcagccagctcaacaacagtccatcccagctccatcccccaaaggttcagcggattgccgtctttactgatatcaacattaacgccagcaatggcagttgaatctttgcctacccagtttttaccattcggattagcgccagaacccgccacgccaaaactggtattcgtccagctggaaatgtcatctgcgatagagacgtcttcgcgcaactggatatcacgtgtccaggtataacccaccagtggcagattcagcccctggtcgagtcgctccagctccccgatgagaaaggcaccggagctatcaacggttgcctgatcaaaagtaatcattcgtctgttccttaaatcttccaggagatttctgcgttgccgttagcgtcaccggcccccgtaaaaaaagcatcaggtaacgcggctgttttgcctgtcacctctgccgccgtgatcccaccaagcggaaccgggatggaagcatcggctgataccacgatgtacaccacgcctccttttttaacggacgaagcatcagtacccacgtttaccgtcatgtacccacgcttcatggcgtcgcccgggaaattcttatcagtacccacctggcgaaccatgtctggctgcgatgtggtcggatacggacgaacgtagatacccttcaccttgtcgacggtgtcaccctccgccagcggcacgaaaaagccgtcagcgtcgtatttgccagccagaccatacgctgcgaaggcgttatcggatttaaggatcaccggttcgacggttaagtcctgcgggcgagagatagccccggcaatgccaacaggcatccggtacagatatgcagtcattggattatcctttgcggttagaccagaagtcggcgttttgtttgttcagggaagcgatgctggtcatgcccatgcctggacgttgtgcatcgcccgtggtgctgcgggtgtttctcccttttgcaatctcagatacggcgttaaacgccatatcaaccgattgtttaggtaatttgcggatatcagcgtcaccgacaacctggcgaaccagtgttttgtctgcggccgccagcacatcacgtttaaatgcggtcggtttcaccttacggctcagatcgatacccgggataatgacttcagcgcgataggcagagtcacccgtaatcgtggtttcctcttcgttgtcctcgccgtcgccggtcgggtctttcttatctttatcatcaggggtgtcagcattatcgcctgttgccgttccttccagcttagccagcagggccttgagcagggttttgatatcgtcctcgccgtcgccggtcacatctccgcccatctccggctttttgtccggcaatggttgttgtggtgaaaggttaatgttgagattgacgccgcccggcagatcaccttcatcccccgttacagccgctggcgctgagtccagcagttcgttcatggtgtccgagtcacctgttttgatggccgtgcgcatgcgggtccaccagcttttcttttgatttgccattgtgtctctgtctccaattgcacaacgatttccggctctgcctttggggacaagagccacatggtttccggtaatatcgacctgctcagccttacccggctcagcctgttcatattccgcgtcatagccacacgacacttcgcgcagaccatcttcgataagctgaatggcgctttcgtctttgacgataaggtcagccagcatcaaatcagactgctcaccagtcccgcgccggacattctgaagatgaccgaccgcaagctctttccagttctcgggattgaccaaccggacgttcccgttttcatcctccggatgcaggatcgtgatgctcatcccttcgaaggaggcaagcgtggccggatggaatacctgctcaggagagcgcgttacgactatctcaccgaacttgtcaggcttgaggtttggcagatcagcagcgccgtaaagctgcttacccgttcgacctatcggcacgtctctacacagcagcgagccgtcagccagctgatagcgggtttcccccagccgggtattgaaaaaatatttcatgttttacctgcgattcaggcgagataagaatgagggttggggaagacgatttctttataacagcggcagttcgggagctcgccagcgtgaccggtcatgccgtcaagcgttgggggtcgtccccattcgacaaacttcccttccatctcccgatgagaatgccggacgtcgccatcttcggctgtacgccagatataaccattcgagccgattgacagcgctcgcgcctgatcgagcgcgccggttgcacgtccaagttcggtacgggcgataaggtcagccctggactttgctatatcacccgatgctgcaatttctttagcaaaatgctccgctctcccaccggtcacaacagcttcaatcgcccgattctggatgtcgtataccctgtcagcagcctcgaggggtagcgatttaatgtacttaacctgttcggcaacgatggatttcatcacctgccctggcggggcattgctcaccagattgcgtagttcacgactgatggttttgctgtgtttccgccactgctcatcattcttgcgcacaatgtcagcggtaaagttctcagcaaccttcgtcgcccacggcgttataatttcgctgtagcgctccagggcctccatgatttcggtgacgctatcgtttgaaccatcgtagtgcccatttacgatatccccgaccgcccgcgctatctgccgtaggctcgttcgatatcggatctccgcctgtcggctctggcggtttgtcgacaagttcgccgatgcctggtggcgcttcgtcttcggcattctcgatatcctcgtcggtaatggatgcgccgatgccagtaacatcggagttctcacgcaggtcggtcatagcggctttggttgtcatcagacctgcatccagcgcattgacaatcgccgttgtggtattcacagccaccgttgagcggtccacatctgacatctgccatagcgggttaaactcaaacgtgaaatcgtccggcagcggcttaccgagctccgaacgatgcataatgtccagcacccggcgcactggcaggcgtaagcgacgctcctgcaatgaactgacccggtcataatagttggcaaggtctgcgtcacccgttgagaaacctttaggggactgcccgaagaggcgcaccaatggaatgccaacagcaccgctaatctgctcggcgaactgcgaaagaatgtcatccagaccgctgaaactgtactggtgggtttcgaaggtatccttggcatccattagcgtcatgccttcattgctctgaaactggcggatcagatcaatgtttttcagcaacgcctcgaatgccgggccgcccagtgcaataagctcacggagtttttccactttgtaggtccgcagatgcgctttgtagaccagctgcgccgcaccgacagtggcgctgtcgaacgcagtaagccgatcccagatacgctctacaaccgacattccccattcgttctcggtcatcttctgctggaatggcagcgtcaccccatcgaagcgaatcaggcggctatggtgaatacgccaggcggggatgcccgttgcggtggtcaccacatcataaagctcgggcttgccgagatttggccccatctctttaatgcggcgcgtcagtaccgggttaatcatccagcggtcgagcgggagaatacccttaaacttgccttcaccaatggtttcgagccgtagcggggtcatgggcgcctgaccttctatcatgatgaagcccaccgcgccgccgtagagacgagaccatttcagtacgtcgttcagcgcatcccagatttgcaactgatccagttgcgcttcgagagtgccacggtcttttgcgtcaatctcagaagtgatgcgaatgcctttgcgggtcatgtcgtcggggatagcatctaccgcttcaccgatgagccaggatgagcgataggaccattccaccagcatacggttgcggctggtgaagttcgcccggtaggtcgatgcggagtgctggttaggcgtctgcatccccacgcgggtgacaaagttctcgtagccgtcggccgtggcctgcaccgttcgtcgcgaggcttgtttgtttcgtgccatcaggcctgtctccccaactgttcccagatgtccagcgatgtgtcggttggcgcgaaagccataatgaaagcgtcggcgacgtttggtgacggtatatcgcgttttgcgaggtcttttttactttcgaccatcacccgtccgttacggtcgaaatcgcgatgaggcgttgtcagttccagtttcagcttttcaagcaacggacaacgagaatctatgctgatcagctcatccacaagatactgttctccgttgttaatagcgttaaacgtatttctgaaacggtcagccaccagccaccacgcctgcgccttaagatttgcgaaaaagtctttgttggggatgccgttgtattcgtcatctggctcatgcacacctgcaccggcgttaaaccgctggtaattcacacgtcgcgcgtatgcgttctcacgcttccggtcatcgttaatttccgagaactttgcgcccgccgacgcgccaacaccgattgagtcgtaaacgatatctgcatcgcgctccattgcagcctggtaagtgcgctggcaactcttcagcaactcgtcctctttggccttccattcatcggcccagtagataactgagccataacggtagacgttggcgcacttatccgcgccactgtcggcgacatcgaaaccgatgcgcttacgtccttcaggaccgaaatccagaaccttatgcgcgtcaacagccgcttcaatccacgaaagcttaataattgccgcatcatcatcagactctggtacgccctcataaacatgcacaaacccttccgggtcacgacgccttgccgcatcgataaccttcagcatggtatctgaaaggaatggattctcgtcgtagttgattttgcgaatcagcgtatcttctggcggatcgaccacaaagttacgccacacgaaatcggtgaccagtccagggttaaaaataaaccaacactctgaaccctctttacggattgtcggctccagtattttccattgatattccgtcagtgcatgggcttcttccagccacaacacatcgatcccctccagtgacttaatttcttcgatgttgcgccataacccataaaaaacaaattccgagccggtaacccggttaatgattttgttgttcagaatgcggaaacgatgccgcaggccaaaccggtctatctgaattttgagaagcgtgtaaaccgattcttcaattttgttctggatctggcgagcgcagcaaaaacgcaggctgtatttatttgccaagaatattgcaaatccggctgcatcccatgattttgacgatgaccgcccgccatagagcactttatttcgcgcctgcgtggtccagaagtttctcagggccggattaagcgtcggtctggatatcggcgtagaagtcattcaggtcacgttctccgttaccatcatcaataccagcatcacgtcgcagcctgtcagcctcgagagataccttatcagtagccgccaaacgataatcagtgtcggcgtgtattttgctaacggtcgccagcgttccaacgatggattcaatgcgcacggtgttacgcatcatcgccttttcggcagcgctgatgttatccatcagaattttgcgctgctgctcttcctccgcatcctccagcagggtgaaccagcgaccaatgttctcggcggccatcaggttattcgcccgcagccgaaagagctcatcttcaagcgtcagcgctctggcatcctcaacaacttcatctttcagtagaaggcgccgggcgtaaccgccatgtttcagtgcatactgattaccaggctgaaaaggaggatgattagtgacaacctttttgcgtaccgcttcgggtttcgtatctgcgggaggtccggattctggccgcgaatgcttttgcactgcgccggagctggcaggcctcctcgtggtacgcaccgtgtttttttgcgtaccatttttgcgtacctgcgtaatatttttgcgtacccactccagcttctttgctttcttccttatcgccccttccgttacgccgtacagcgcccctatgtcgcgaaggctcataattccggcccggtatgccgtctcgatggcctcccagtccggttttgccatgttgctgtcctatggttaaagccattaaaaaagccacccgaaggtggcatttgtgatggcaataaaaaccgcccggaggcggcttgttatcaattacttaatagctgttcgatattagatgggatcgggacaccaggctctacttttagtttgtttagcctttcgacaatagacagtttctccgccccactcgctgcttggtagtagggtcttaccccttcaatgatatcattagctgtaactgaagaaccaacgccagcgcctggctcgtttttattcaaagagctgtgaataatttgctcaatagcctgattcatagttattacccaaaatgagtggttacataccacaacttgtatatatgtccaccacaggcctttatcaagcccacccgtagataggctttgtaatggctacttcactgtttcgatggtcgagccgtgagagttcatcacgtaaacctggtcgccaggatagatgaactggtaacggcagccatcacccgcgccggggaaattttcactcggatattcctcaataatgatggcaatagcatcagtatccagcacatcagtacggtcactaataaccagttcttcctcctgcagcgctttggtcatttctggatcttcatagatagccgggagccagtatgcgaagtccgggcaggctgagttatgagtaagttttaaagtatctgcgaacgtttcagaaccggccctggctatcgagatggatggctgctcacaaatatgcgtaacaccgttgatgatggttttaactgtaaacatagtatttccttcttcgtcttcttgttacaacaaaaagccccgctagtgcggagctatgggattgttggttgactctctcaccgagttgtaaatgcgctcacacgtcattcctgcgcggtagctttcgtcagatcgctcagcataatattgagcttcttctgcaaggcttccgaacatgtcggcgagcactgtggcgtcggctccggctgttttgcttctgacggcagcggcaagatttgcggtgtgctttgcggcgtccaggcgggtggcaagtttttttgcttcggtacgcagctggctaacagtggcagacaggccagcagcagtggcagcagatttagcggcttgcgcttgtgcatctttcacagcctcatcacgggcaataatgcggccctgttcaataatacgggcggcggtctgggcgttgacttcctgagaggattcagcgctgtcgcgatctgcccattttttttgccagcccctgtcactccagacattaccggcgataaacgcaccagccatcagcaaaataaacgccagctgcaaccagtatcttttcagaagagcagataacagattcataccagcaccgattttgctttctcaaagcgctctcgccgatcgccgaagccgttctgccctccgttgatgatctgcgtaacacgtaccaggtcgccggaatatttcagacaccctttagtcacaaaaaaccacgctgcggatcgggcggcatgacgttccagttcaagctgtcccggattcgccaccagatccagtttcagggcaacgccacatctggtgtaattctccagcccggtaatctggataagcccacgcccgcgatacttccagccatctccggcgtctttgttacccatgcggccaccgtaaaccagattggctatttgtggctggtgggcaacctggcgaccatcaatacgccccagcatttcgcactgatacggcgtcaggcgtttaccaaacgtcttcttcagcgcctccactgaataattgaagctttccttcagaacagtaaatcctgctgattcatgtcccgcttgtgcaataaacatggcctgatccagtggcgcagtgataccgaattcgctcattgccgccgtaatatacggataccagcgcgcagaaagcccggcgctaataccagccgcctgctgaaattgttgttgattcatcagtgcctcagagcatcaaccagacgcgccacattaccgcgagcccacagcacagcggcgcagataaggatattcaccatcaccaccagccagtgggatgattcatataaaccaaaaacaaaccggaaagggacactggcatacaccagcaccatgacataggccagtaacgaaatcagggggcggtgtgtcgcatcaccgcgtcggtaaaacatcagaacgatgactattaccccacaaattacggcattcagaactgcagaagggtcatttgctaccatctgatccccctcccctgatacgagagagaatactgaacagagtgttcagatcctgactgttgagaaaagtgagaaactttatacacattgcagaaataattactgcgccaagtgcatccagtggtttttcataatgcgttattgccgcaagcttagtacctatcagcccggcgccaagcactcccacaataaatgacgtgataaaataagcgaccagcctgatgcgtccgatgttggttgccgtggcgacataaaataccgagccggcaaaagcgccgaataccacaccataatcggttccggttgccagaccgaatacactggcccccattaatccaccagccaacactgtcgcactggatacaggttcggacattcatccccctctggttgtgtgggtcctctcagttatgaggggaaataataaatatcctccggcatagccggaggatatttattcataaagaacacaattaagaataataccgatttaattaaaataacttgatctcacagttgaagaatgaataatagcgagccctgccaaggcagggcatagaaataaccaacgagaagaaataggtaggaactaatgaaaaacaccgctctgggtaagttcatttttatcgtcggcaccgcgttactgctcggtggctgtagtggcatggtcatgcctccctatgccacccacggtacatcggtcggaatcattgcgccggcgggaggctatagcgagtggcacacggatagccgcaaccacaccacaggagacagtcacagccagtcacagggaaactgcacccaaagtgaagatagccagctcagcgaaaatggtctcacacggacacaccaaagcaactgtaacacccgtagtcaaacccacagcagtagcaccagcaaaacccgctccagcagcgtcggtttcagcgtcggggggcctgttggtgctagcatagggttgatcaagcagatggagtcgatgaaccgtgcgccagccaacgatatgagtagtaatgagatgttcaagaatttcggtttctagcacataacgccacctggtaccgttgtggtgtctggcccggcggctatctgtaacgactcacaatcgaaaaaagtcagactcgcaatcagcgcaaattttggctcacaataactgcaactgaaatcggacgtggactcacgctaagtgagagcgaaatccgacgctcagagccaaatgagaagttttttccattggcagtaattgtgagccagcaaaaatagattgtgagtccattgaatggggatcgttgtgcattttcataagcctcacctccgatagctcggatggcgcagtgtgaagtaggaaggccgcccggtggatcaacgacaaagctcagagggattattccggacggcacaaacagaaaagccccggcaatcaccgaggcttaaattgttgccggttaccgctccggcgcgatcagcaaaagctatcgcggtatcagattgtggtcctgcccgtgtgagctttgcggtcggctggaacatgtagactccgcatcactccccgcactttgtcttattggcgtcgggaatccataaaagaaaaccccgccgaggcgaggttcttaattcttgtaacgtcacaggcgtaataacccatcgttggaatcaggttagccattttccgttaattttgcaatagctaaattattttggtcatcgagtcacgtttcccagaaccttttctgcatacgactcctcaatatggcaatgctccaccagtcgatcgaaaaacagtttatagttgtaccgccataccatttccgttactcctagtgctttaaaaatctcggtatctttgagacgtgggtagcctcttcccttgcatcttgggcattttttataaaccggcacgccctgcaactcagattttttcttatcgagaatttctccgcgtccccggcaacgacattcatttttcacctggcctttgccatcacacgccttacacactacgcgcacctgctcacgaactgatttccacacctcccagtcggacggagaaatacctttcgtatcttttacccattttggtggcttaccatccgggtaagtaaccttgttcgtgaaaacctcagcatcaattaatttagcaccatgacagctactgcacgtcaccaagctggccgcactgagggaataatcgcgaaatacataacgcgccatagtgtcgagaaattttgagcgcttacccttttccattttccgtaatgccccatgccgttctgcacgctgctctgctaattgcctgatgtaggcgatgatattttcagaagataaaaccccggcttttgccagatacaattcaatacccactgcggcttttgcagtaagtagcccgagagatgccattacgtcagtaatagtcagcgtatcagacgttattccgcatggtactgcgccgggcatcatggatttaggtgaaaaatatttcggtaaggactcaagattcatttcgatgctcccgttttgcttcaatgcggacgtaattacgaagaatgcggtatgccacaggaaaagatccccggtatcgataaattcggagacgcaaccagcgcatgcggagtatctcgatcagttctggtttcatgcggcctccagcttttttagcgcacgcagatccgacagtgccgcgagcctgatttccttcagctcctcgaccgtccagcggtgcggggtgttattgttctcgagtgccagcaccgccgcctcaccgtaacgctcaaccagcgcggcacgatatgcttcgatgttccctgatttgtagacgttgcagacatcacactgaagatggatgttgaagcgagtgaagcgcagatgcccggcggcggccgtactcctgtaatggcctgcatgccatgcgaatgccgtcttcgttccacaggagatgcaaccgagtccttctgccagttcggtttcgcggcaaatgtcatttacggcgcgctgcgtcaagtcaatccagtgtttcagcggcttaaccgcggctttccgctggcgccaggcggcgcgttcttttttctcagcggcgcgctgaagggattgcgccttacgttgcgcggcttcgcgagcttttctggtctgttctttgccgacggtgctggcgcactggtacgagcaaacgatctgcccctctcgtatcgggtgaaaccactggcggcattctttgtttgcgcacttacggcgcggtaatttagccatgttcacccccagaccttttggcgtaaggattttggcgtccgcacccggtgtgcatattctggtaatttcgcgctgacagtccaggtaatgaagtcagggttcaggctcttttctgtccttacgccccgcttctgataatccgatatcagcgtgtcggcctgctcggttgtgcagtcgtgatgatggaaccaggagtatttcatcgccatcaccccgcaaagctcatgagctgggcggcggcgttctccgcctcgcgctgagtacgaaatgtacgtgataaaatccaccgccagagcacatcaagcgcggatttatacaactgctgaaattcgacctcatccatgctggaaaaagcgatgctgcggggatgtttgcgaagggtgccgtccggtaactggatggcgtcatagtgaccagcctcaaccgtcacccatgcgcggtatgcatcgaaagatttacagaggctaattccgtttgttacccggcggtttgcaatctgttccagatactgttcagccgcatccagtaatgcgctttcattcccgccatatgcagcgagaaactttgcataaccgtttaccagtttgcgctcattggcagaaatggcgccgccggtgggttcccagtattcaaacccaagattaagcaacgcgaaaaagcggcgatggaatgcaggattcctcacctgacggaactcagccaccagcacggcgccgagtttgatttttgattgcagaatatcactggtctccggcgttgcggggatcagaattccagatgactgcttgatgagttgtaattcgtgcgccatggcgttctccgtggcgcagcaggtgcaggttgttcaggcctacatttgaagtgtatcaaagcaacgggtaattcgatagcctgccttttctaacatttgcgtaaataatgttggagttccaactatgtcatcagggtgaaggggaacaaaagatatctcgtcaccacgacgatacatcagggcgcgtccgctatccggaatactaccgaaccttgccactacacaatgatcgtaacaacgtataaccgcataccctgattctggtaagtcttctaacatgtaaccccccgtcacactgactttatttctggaaacgtctgcgactccacgatgcttaatatgcataaaaccagtcgtcagcgctttcccacgtttcctgcagaatgctctgtatacgttttttatcgccatcagcagcaccgacgatactcagaccatcctgactgcctcgacggatggttaagttgcagttttcatactgattctggagacgggtaattaattctttttcaagtgcaggcacggcaccttccggaagctgttttgtccggctgataacaagttcaattctcataattccctctacatttaactactgtatataaacacagtatacctgttagaaagaatattcaagaggtgaatagcactttttgcaaaagccatgccattgtataggaagagtttttcctagtattcggaatttactaaatcagttaggcaaaggctgaaagcgaaaaaaaacccgccgtagcgggttattcattcgatttgattcggatgtaacgtgaggtcgccacgagagcctgaatcatattaccgccagtttcgcataacgttctggaatcatactcgcgtgaccagtggcataaccaattttccaggtcatccactgcgtaatctttacgagccaaaccctctgcgatggttacaacttcatcactaggtgctgtaagctcatatccgttcagcaacaggaatacgtaacctgccatcatagcggtgcgtttgtttgcgtttgcgaatggatgattctggattaggctttcaattagaacagcagacagacgaaacatatcgtctgtctgctcataatatcgaatggtgcttggccgggactgggaagaactgaggttgttcggattcagtacgcctatcggttcatttggcgtctgaatctcgatcagagacctgttgatgtaaacgatatcttcaatggaaagataattgactccttcaacatactctatcgccatccgtttttactcagacctttgaaagttcttccatcgccttctcgtaacgagcaaacccaaactcaaaggcgtttttaacttgaccagtatgtgaacatgctttgctgatcgctgcacgaggtttcgccaccatggatttgtcacgaggcggaatgtacaagcgatctgccttttttaatgcgtgacccatgattatcaccctcatgcacgtttggcagtgctttctcaaattgtaggatgtaaacacatccaaagaatttatgatcactttaagtggttgaggacaatttaataccattcgtcatatttgagcaatgggcctgcgtctgaagatagaagcatgttcgacgaaaatctcaatggccactttgcaagttaacgacattttcgcagaagttacccctcaggtaatagtaaactattgtcacgatctcaggagataggctggtcctgtgagtcgattaaagtggacacaaagccaataaatagcactttttgcacaaaaatcatatcctggttggaatgcacaacgcccaacattgctgtagtatttcgccccctctgaatgtagcgctcagattttaatcgacccaatcccgccctgcttcaacatcaagccccgcatatgcgaggcttgttgggctaacccgccgcagcgggttatgacgcaacacttcatgccggagttttccgatccgtcttgttgtgaacctcccagagactaatgccgcaactgaacacaaactcagccagataatttaaaccggaccattcccggatgccgccgcgcgccgcttccacaaatacagcgatatcctgatcacgccacactccaaacaggcgccagccgccactgtcagtcttaacggctgctatacgcgtcagaacaccagtctggtacaggtcagtgaacgcaggtttcttcctggttattattcgcatatctacaaacctaagaaatgttgattacaaatcactgattcgtattttttgattttgcactaatgccgatcacaggaccggcatataggtgtttcacgatttacctccgttgagcatggcagcgcgacaagcgttccagatttcttacgcatcgtcgtcgttgaaaagcgcatcagaatgtgaagccatcaggtcgcgtatttcttccggacattcttccggcactaccggcactggctgctctttgatatgcagtcgtggctcgccgtctttcggttcaggccattcgcgcttcttgttcaccgccagcttttccaccatcgccagggcaatctgctcgtcagtaataccagcgcggcgttgtgcatcccataacaggaattgcatatcagcccattcgctcaggtcgccaagttctgcggcagtttccaatgcttcttttgagaggtgcttcagtggaccgatggggccaacatcgccgaatgtggcatcagaccagtcagcatgttcatggcgaacttgttctcgttccagcgatgccagcgcacgcttcagcacaataagaattttggcgtcgtcatcgctcaggccaaacggaatatcatcgcgagtgttttcaaattcagcgatggtttgctgtagccattctttggtaatagtggtcatgggttagtccttcacaaaaataatccagtgggttttatcgttcttgccggtgcgctggccaataattggtttcacgtcagtaagcgccaaaatctggctaaccggaatctgcgtttcgttccatttgaaaatgagaacgccgtgtgccctcagcacccgaaacgcctctttgaatccggcgcggaggtcagaacgccatgtttttttgttgagtctcccgtactttttgcccatccaggccgtttggccgacacgttccaggtgaggcggatcaaacaccacgaccggaaacgacgcatcagcgaacggtagcgcacgaaaatcagcaatgaggtcaggactgatgactaggcggcgaccgtcgcacaatatatgctcctcggcgcggatatcggcgaatacggcgcgttcatcgcgcttattaaaccaaaacatgcgcgagccgcagcacatatccagaatagattgcgattccatcacgactccttaaccttgatgccagcggtgcgtatttcgtgtatcgcattatcattaccagcacaccaaccctcggcataatcccggctgaatccggtcatgtgcatgacttctccaacgctgagttttgacaggttgaccttccgcgcctccagttctgccacccggcgagcctcacgggttgcaattcccgcgtattcaatcaggcgttggtccagttcggctatgaggcgttctgctgtatccaaatcctcgcctaacttctgcgccatccgaaaccaattggcgcgctgttcctctttggtttccagctcatccagcagcgccagcatggtggcggggttggctgcggcgataaattccgcgtcacgtttctcaacagtatgggccaacgtcacttcttcaccgcaaagagaaaatggcgttaccgtgatgccattgaacagtgatgaggtgcggcgccaattccccggcgtagccctctcagccacttcacgaagcgcccgtttgtcgatgttgctcattgggctccccccttgttgatgctcattttggatgctccataaacctgcattaccgggcttttctccagcaccggcagcgctgaaaatcccgttacctgactactgctgtatcgcctgaggtcataatcaatcaccgcacgctggtctcggaaaatgccgcagcggccatgacgaatgaagccgcctcgctccagcgcgatacgcagatatttctccgccgtggttcggtgcacgccaaaaatcgcaacgacgtcgttcgtcgtgatgcgcccctgctctttcaccagaccgataatccgctcaagaataatcatccgttcgctgtgtgttttaggtcgggccatttttaaccccttatttcacaatccggaggtggctaacgtttttccggtagctttcccagtcaaaattcacccacatccctccgtccatctggaggcgatcgataaccctcgcgcccagtgaatccaacagcccctcgtggttaagattcgtcagaacgccaacaggtcgcatcgatgagagacggcgatcgataacctgattgagaatgaccttctcaccactgctcccgcgctgaataccgacttcatccagtaccagcaggtcaactttgcaaaggtcatcaagcagggacgcttctgattgcccaccgtcgtagcactcacgaaccctgagcatcaggtcaggaatggttaccaccagaacgctatgaccgccggccagcagatgatttccgattgccgccgcaagatggtttttcccggttcccggaccaccgctgaacacaaagctcgcaaatccactaccgaagttctgggcataactttttgccatcgtgtacgcttttcgctgcccctccccgcttacttcgtagttagcaaacgtacagctacgatggagatcctgaatgccagatcgcccgaaaatcttctcggtgcgggatttctgattcatcctgtcaagctcttcactgcgtttacgcccttcggcttcctgccatgcccgccactcatcagcagtcgagaatttcggctgcacactggctgggataattcttttcaggcgatcaagcgcactgccagtaccgattacgtttttcatcgttaccccctgaatccggtaggaatggttttgtctggcgcagaaatgtggttcacatctctgccagctcttcggtcgttgagagcgaacttcggtttgaatagtccctggtagccgttggcaatgcttgtgttgatgacgtttaccggatcgtggccttcatccaggcactccttcagaagcctgaaagcttttgttaccgtcagttcggtttttatgggctttccggattgctggcggtatgtgacccattcgttccacgacgcagcattcagccattcgggaacaggaatactcaacggatcaaacttcacttttcccttagggggattaaagggggttagatcttttatatttgtctttggaataatgtctttggtgttccctgttttcggggatgcccttccctcttttcggggataactatccccgttttcagggatggctgaatggggtaaaacgctatccctgttttcagggataactatccccgttttcggggatgcccttcccccttttcgggtataactatccctggtttcgggtacagaaataatccatgtggcaatttcatcatcaggaaaagacaccggacattttgagcaatgtggcttggaataagcccatttatccaggtttgtattaatccctatgtatcttgtttgaccaatacggcgcaggataatgatgttacgataggcaagactcagcaccgcttcggatacatgctttaccttcagtgttgtcttatctgcaatgaggctgttggcaatacgatctgattttttcgaccagccataagtcagccggataatcgcattcaaaacacggaactcacgccccgatagttcaacgatacacaaggcgtcctggatctgattagctaaacgtaaatagccattttccagatcagccatacggcactcctgttgcgtcggtatcggcgcagggaatttgtatatttcagcggtatttgacatactcatctccgcaattacctaccgtttttgcaccagaaagccgttggtgacccctcaccgcggctttcgcctttttggttgctgtcattttcagtcccaccccagcgcatccggcctggctcgttcagcctttagcccggcatcagcgagaatctctacggctgtgagatagtttctggataccagtaccgcttccggtggcgcggcctgaatcccaagaaaagccagctctttcgccatgttgcagaaatatccctcagctttacgcctgctgactgtcgactcgctgatgcccatatgctcggcgtatgatttctgccctactgatgcaagccggttgagcaggacactctctatctcaatcgggttgatttctggtgggtctaactttcgtgcaattgcgttctccatgggtaaatatcctctatggttatttggctgatgcctcttggcttggtaagccatcggttgggtttgggtagagatcaggacgcagttcgtgtggggtgactttccagtcaatagctcttgccactcgaactacaagttcgccgggaactttgtttttaaaccagccgttaacggtctgagcacggcgaccaagtcggcgtcccaacccagcctggctacacacggaaaggatcttgcgttgaacagttactttcattggtcggtctcattgagtgaagatacaaccaattattcaaatttaatcgatactgtcaaattatttcgatagacatacctacagaaaaaatctgtataatgaaaccatgtaattgtgcgagaacgaaaaatgaactttggagagcgtttacaaagagtgcttaatgagactgggatcacccaatctgagttaggtcgtagagtcggcgctacctctcaatcagttaatggttggtgtcagtccggcattcttccccgaaaagatatcttagagttgttacctaaggccacgggtaagccgttgtattggttcttcatggaggatgatgatgaatcggatgtgcctgaacgtctaacacaaggtggtccaacagatctcaatgaccgacaaaagcggctcttagaaatatttgatcagctaccgactgttgaacaagaccgttttattgagctggcaggcaccagacttcaagaactagacgatttcatggctgaataccaaagacgcagaaaaatcgagcctccttctcgctaaaccagctttaaaactactaaccgccttaactggcggtttttttatgtcattaattcacccacatctcgctttcttaatcttccctgtaaaattaatcatcaaatttaattgacatgtatcgattgaatcgataatacttaacctatcaaccgcagcaacgagtcatcaaggcaggacgcccacgaagtagccgcccggggcatacgaagaccgggatgagatggcaaggttaacgcgcagcaggtgataaacgttccgctggccggcgataaggcaaacgagggtgagatgactaattacggcacaacaacattaccaagaaccagcgttgtaccgggaatgctggttaagtaccaggggcgcacataccgcgcatctgcaaacgtaggaaaagggttgtacttgtttacccttttcgaacgcctgcggacaaccaacgacgagatcgaggtttacctcaaccaacacggcaaacctgcaacccattagcaggaaaaaccagcaaaacgaaatactgcacagattctggcagaccacatggtgtcggggattctgcaaaccaaattcaggagttcagccatgaacgcatatctcacttacgaccggatcgaggctcaggactggacccggcattaccagcaaatcgccagagaagagaaagagtcagaacttgctgacgatctggagaaaggactgtcgcttcacatgctggagtcgctgtgtatggacgagctaccacgccacggcgccaacaaaaaagcgatcagccgggcatttgatgacgatgtcgaattccaggagcgcgcgtcggagtttgtgcggtacatggccgagacgttttcccggcatcaaattgatattgaatcagaggaataagacaaatgagcacagcactcgcaacactggcaggaaaactggctgaacgtgtaggaatggattctgtagatccgcaggaactgatcactacattgcgccagacagcgtttaaaggtgatgccagtgatgcgcagtttattgcgttactgatagtcgccaaccagtacggtcttaatccgtggacgaaagaaatttacgcctttcctgataagcagaacgggatcgtccctgtggtgggcgttgatggctggtcccgtatcatcaacgaaaaccagcagtttgacggtatggattttgagcaggataacgaatcatgtacatgcaggatttaccgtaaggaccgtaaccatccgatctgcgttaccgaatggatggatgaatgtcgccgggaaccattcaaaacccgtgatggtcgtgagattactggaccgtggcagtcacatcccaaacggatgttgcgacacaaagcaatgatccagtgcgcccgtcttgccttcggtttcgcaggtatctacgacaaggatgaggccgaacgcattgtcgaaaataccacgtataccacagatcgccagccggaacgcgacatcactccggttagcgatgaaaccatgcgggaaattaatgatctgctgatcaccctgaataaaacatgggatgacgatctgctgccgctctgctcccaaatcttccgtcgcgatattggtgcatcgtcagatcttacgcaaatcgaagcagtgaaagccctcggattcctgaagcagaaagcagcagaacagaaggtggaagcatgacaccagaaattatcctggctcgtacaggtattgacgttagcaacatcgagcaaggtgatgacgcgtggcaccgtctacgcctcggtgtcatcactgcttccgaagttcacaacgtcatttccaggccaaagtcgggcaagaagtggactgatatgaagatgtcctactttctcacccttcttgccgaagtttgcaccggcgtggcaccggaagttaacgccagggcgctggcctgggggaaacagtatgaagatgatgcccgcaccctgtttgagttcaccactgacgtgaaagtcaccgggtcgccgatccttttccgtgacgaggacatgcgtaccgcctgttctcctgacggcctgtgcagtgatggccgcggtcttgagttgaaatgccctttcacctctcgcgactttatgaaattcaggcttggcggcttcgaggctatcaaatccgcctatatggcccaggtgcaattcagcatgtgggtaaccgggatagatgcctggtatttcgcgaattatgacccgcgcatgaagcgagaaggcattcaccacgtggttgttgagcgcgacgacaaatacatgtccctcttcaatgaaatggtaccggaatttatcgaaaagatggacgaagcgctaaaggagattggcttcacgttcggggagcagtggcgatgacgcacgcacaggacgaaatcagggttggcgcgatgcgccatcccatgttgaagaattaaatgttagaggacggaagtatgagcaaaattggtgactatttctttgaattcccggcatcaagaggcttacagggaaatacggttgtgttgatgatgacagtcccagcgcgcgcgctaactcgcgttctggcatcagataaccacggcaatacgcttgagcgttctcagcgagaactcaatccagcgcgtgcgaagaagttttatgaatacctgcgaacagcttacgagaaaaaagagccgttcatcatcccgccgctggttggaaactgcgactcattcattgagttcgaagagtttggcaatacgaatgtgggtgtcgcgcgattcccaatggatgcggaaattaaactgtttgacggtcagcatcgcgccgcaggcattgcagagttctgccgcacttacggagagcctattcacatcccaatgatgctgacacaccaactgccgctcaaaacgcgccagcagttcttttccgacatcaacaacaacgtatcgaagccatcagcggccatcaatatggcctataacggtagggataaaattgctcaggatatggtttcgtttttgtcatcccatgccatgttctcagaaataacagactttgaacacaacgtggttccggcgaaaagcgatctctggattagcttcaaacccctgagtgatgcaactgcaaaattctctggtaatggggatgagcttgctactagtgacatctatgacatttgggaggcatggctcaagctaacagccatcaagggaattaggcatggttgtacgcctgttgaatataagcgggattacatccagttccacgcggtgatgatcaatgcgtttggctacgcaatgcaggaactactacggcatcgccctgcacacatcattgttcagatgattgaggagttagtaaataattccactatgagtgagctggagaatttcttcctcatttcatcctggtccggtgtctgcgccagcactgaaaaagatagagcgacagttattgccagcgttgcttcacaaaaagctgcttcggtgagactaatccaagctattacgacaaagagctttgaggtcgcagcatgagatacggctctgtttgcagtggaactgcggcgatgcccatagaggaaccggcgctgcgcacctggcgccgcccgttcctgaaatgggcaggcggtaaatattcgctgctgccggaactggatcgtcttatcccggcaggtaaacgactgatagagccatttgtgggcggcggatcggtgtttcttaactcagacaagcacgaacgcttccttctggctgacgtcaacgctgacctgattaacctgtaccagatgctggccgtagtgcctgattcggtaatcgcagaggctatgaaagctttcagacatctgaatgatgccgaaaactacacagtaattcgtgaagcattcaacgcccagaaactgaatgcgacagaacgagcggccgcattcctttacctcaacaggcactgctttaacggtctgatgcgttacaaccttgacggttttttcaatgttggatggggaaagtataaagccccatatttcccggaagaagagatcagggcattcaggcagaagtctcacgcgtgcgtatttatgactgcgggtttcgaacgtactctcaggctggcgggtgatggtgatgtcgtttactgcgatccgccatacgagccaatgcccggcaccgctggcttcactaactacgcctccggtgggttctcatgggatagccaggtagcgcttgctgaaagctgtgtggcagcccatcagcgtggcgcaaaggtgtttatcagtaattctaccgcaccacgcgttattgaactttacgagaggcacggcttcactctgcaccgggtcaatgcccgcagatcaatatcgagtaaaggcagtacccgagaaacagcgaacgatatcgtcgcctcactggggatttagtgatgatgaaacttattaacagaagtaagcaatcaccagtcggtcgtcgcgcatgtgatattgcactggctgcgcatcatgagaagttcggcgattacggcagacaaaagcacgttaccaattacaccgttgtagtggatggcgtaaaggttcctgtcgaagtagttaaccgggccaccagctacgtagccaccgcaatgatcggcgtccggaaacttagaaatctgccagcacaggcaaactgaatattagcgatggcccgctgcggggccactggagaaaacgatgagcaacattatccaactgacgccaaacaagtgggttagcgaaaaagttctgattgcggttaccgggcttaagcccggaaccattacccgcgccagaaaagaatcctggatgctgggccgcgagtacctgcacatttcaccagacggaaatccgaagccttcgagcgaatgcatatacaacagagaagccgttgatcagtggatcgaggcgcagaaaaaaaatcaaccaggtgcgaagacaacatgaaaagcagtacactcgtcaatgctcctggacgtcaggagggattaatggctaatgcatcatacccgacaggcgtcgaaaaccacggcggttcgctccgcatctggtttctgtataaaggtaaacgtgtcagggaaaaccttggtatccctgacactgcaaaaaatcgcaagatagctggcgaactgcgttcttcggtttgttttgcgataaggatggggaattttaactatgtggaaaaattcccaaactcaacgaaccttgcccggttcggtcaggatagaaaggaaattactgtgctggagcttaccgaaagatggtccgagctgaagagaatggagatcagctctaataccatgagtaggtacgaatctatcataaaaaacatgcttccactcatcggcgaaaacaaaatggtttctgcggtgactactgaggatttgctgtatgtcaggaaggagttgctgacgggctttcaggtaatgaagaaggatcaccggactcaggttaaaggccggaaatcgtccacagtgaataattacatgatgctgatggccgagatcttccagtttggaacagataacggctatgcaaaggaaaacccgtttagcggaattaaccgtctcaagaaagcgaaaggggaaccagatccactcacgacagacgagttcatcaggtttatccaggcatgcggccaccagcagatgagaaatctctggtcactggcagtctataccggaatgaggcatggggagttgtgcggtctggcctgggaagatatcgatctgcatgccgggacgatcattgtgaagcgcaaccttacccagacggatgagttcaccctgccaaaaaccgacgcaggtactgacagggtgatatatctcattcaaccagctattgatgccctgaggaatcaggcccagttgacacgccttggccggcagtttgaggttgaagtgaagttgcgggaatatggacaatctgtcattcagccctgcacgttcgtattcagccctcaatgcgtcaaacgtggacctcgcacaggatatcactacgcggttaattccattaataaaatttgggccccgataatcaagcgtgccggcattcgttaccgtaacgcgtatcagtcacgacatacctatgcatgctggtcattatcagctggtgctaacccaaactttatagcaacgcagatggggcataccgatgcacagatggtttacaaggtgtatggaaagtggatgtcagagaagagcgcagaacaggtttctctgctcaaccaggcactttcccgctatgccccatcactgccccaaagcatggtagcagcgcagtagaaatccttaaattcaaggggttagcagtcgcatcgctacatttttataacatggggcacgaaatgcgctcgaccctaaagacagcttatggtgtgatcggggttcaataaatcgctaaacaaggtatactccagcggttttcttagttgtttattgtactaaacactcccgtgagaggacgcaacagcgcacctatgacacaattcgcttctcctgttctgcactcgttgctggatacagatgcttataagttgcatatgcagcaagccgtttttcaccactactatgatgtgcaggtagcggctgagtttcgttgccgtggcgacgacctgctgggtatttatgccgatgctattcgcgagcaggtggacgcgatgcagcacctgcgcctccaggaggacgagttccagtggctctccggcctgcccttttttaaaccggattatctgaactggttacgcgagtttcgctataacccagctcaagtctgtgtcaccaacgataacggcaagctgaatattcgcttaaccggctcgtggcgtgaagtcattatgtgggaagtgccgctgctggccgtgatcagtgagctggttcatcactaccgctcgccaaacgcgggcgttgatcaggcgctcgacgcgctggaaagtaagctggttgatttcactgcgttaaccgccaatctcgatatgtcccgcttccacctgatggacttcggcacccgccgccgtttctctcgtgaagtgcagcaggcgatagttaaacgtctccagcaggagtcatggttcgtcggcaccagcaactatgatctcgcgcgtcgcctggcgctgacgccgatgggcactcaggcgcacgaatggttccaggcgcatcaacaaatcaatccggacctggcgaccagtcagcgtgccgcgttggccgcctggcttaacgaatatccggaccagcttggtatcgcattgacagattgcattacaatggatgcgtttttacgcgatttcggcattgaattcgccagccgttatcaggggttacgccacgactcaggagaccctgtcgcatggggcgaaaaggcgattgcccattatgaaaagctggggattgatccgctgacaaaaacgctggtcttttcagataaccttgatctgccaaaggcggtcgagctctatcgccatttcgcctctcgcgtgcagttaagcttcggcatcggtacccgactgacctgcgatatccctcaggtaaaaccgctcaatatcgtgattaagctcgtggaatgtaacggaaagccggtggctaaactttccgacagccccggtaaaacgatctgtcatgataaagcgtttgtgcgcgcgctgcgtaaagcgttcgatctcccgcaggtgcgtaaagcaagttaaccatgcctgtgcgaagcgcccggaaagtgggcgctttgttactcttctgaccatcttacctgttctggccgcgatggtgactattcttccccttcactcttcgacatatttacgtgcgtgatttgcgttgttttttcagaattagtgtcccgctgtgtacgcgttctgaataaattgaattcgctaataaattctttacgcagcaagaacagagcaattacgttggggataaccagaaaaccgacagcaatatcagccattaaccagattaccgggatttccatattaacggcaatcagtggcggcaaaaaatatagccatttaatgatgcgttctagcttatcgccaaagatatagtttattgaagtgcgaaatttaatatatgaaccaagataagaagtaaacagaatcaacgccacaccgagacagagaacctgaacaataatcggatgccatgtttcttttaaggcggcaaagataatctgaataccttgataactggcgtctgtccacataccagaagcaagtacagcaaatgcggtaaagttacaggtaatcattgaaacaaaaaatacttccactgccccccacattccctgacggaaagcataatccacgttggcagtagcatgtactgtggccgaggtacccatgccggcttcgttagtgaatattccgcgactggctcctttactgatggccatcatgatggttgacccgacaaagccaccggctgctggcgcaggggcaaaggcataatagaaaatactttttataacctgtgggatagcctcgatattcaataccactacaccagcggcaccaatgaaataggcaatggtgatcggtggaagtgcaatcgtacagaatttaccaagactggcgagtccttttaaaataaccaacgcgcctacgatgacaataaatcccccaatgacgcttgttgggatgtcaaacgtatagtgaatgaccgccgccatcgtattagtttgcacaaaacaggcatccgtaataaccagaatcattaatgcaaacgcatataatcctgccaggggataccattttttattgagctctttcttaatataatgcattgggccgccataatattcgccattctcacctttacttcggtatttcaccgccagcgtcacttcaaccattttggtcatcatacccacgaccgcaatgatccacatccagaaaattgccccaggtccgccaaccgcaatagccgcagcaacacctgcgatcgttcccgcgcctaatgagccggatagcacagtggcagccacctctattgattttaaggattttttagacgctgcctcgccagtagtgttttgtttattttttccggcaagtgtaccaattgtattacggtaaatttcttttaaattgataatctggaaaaatttgaggcgtactgtaaaataaaagccaatgccgatgacacacaaaaataatgggccaccccatagaaattcaaagagttgtgaaagttgctctaacataatgacctcggatttaaattaattcgttcagtctcagaaataatctttccagttcagcgtaatcctgaattttgccaacaacactaaactggaaagtcagcgggtaggagcatcccttactcactaaatgccgttttaatggtatattgttatgaagttttgcttcctgcattaggtttattatgcgtataaaaaacgcgttttttacatgctgcctttattatctaattttttagtcgtaatgtttaagcactgcgtccgttccagactatatcttcataaatatctggggacgtatcgccttcggtgctaataagcagaacatgagcattggcatcaagctgtaagcgattagcaagatcctgataatgcatattgttcatcaactcataaagtaaccctacgccaatagctccggactcgccggaaataaaaggcgtatcagtgcctggacgcggcgcggcagcaatgcgcatacccttagccgccagacaatcatcagcggaaataaaacaactggtgttgtcccgaataataggccaactgataatattcggctccccacacgcaagcccggccattatcgtcgccatatcgccagtgacgcagtgaggttgaccatcattcataactgcggattgataaagacagttggcctgatgcggctcaaccacaataatattaggggtattttcctgcattttttcaacaaaataacccataacactgccagcaaatgatcccaccccccgcttgtaaaataaggtgggttggcaacggactgtttgtttctgcgagctgctcataagcttcaaccgctagtatcatatagccttgcataatccatgttgggatctcttcataccctgtccaggctgtatcctgcaaaagcacccagccttttgtttgcgccattctatgggccagtcgcactgcatcatcgtagttcagatcggtgatggtgcattcagctccatgatggcgaatattctctgcccagattaacgatgatcccttaggcatataaacgacggcttttagacctaattgctccgccgcccacgccacaccacggccatgattgccatccgtcgcggtaacaaaaacacaatctttaattttttctttaatctcaggagtgttaagggcagcaaaacttaacgagttaatatcacattgcaatttatcagcgagatattttcctacagcataagagccgcccagacctttaaaagcattcagaccaaaacgccaggactcatctttaatatggatggaccctagtccaagccgccggcttagatgcgccagattatgtaacggcgtaacggcataattgggtaattttttatgaaatgctaacacctcacgcccaacatttccgttaagcaaacttaaagccgctcctgtaccatattttttccgacgtgtattaaactggtatttaataagctcatgcataatgataccttttgttaaagtttatttattgaaataatatgtttttggcaattattgagtagaaacaagtaaagaactcgcgttttgtggctgtagtagtggttatcctcactttaataaaccgtactgataaaagagtcgcacaatatctattacgtccttttctttattccgctgattatgatagtactatgcttattgctgttaaatggcgcgaaaatgcccatcgtcgtgcaattttcacctttttttaacggcctggacgcggcaaaattgcgcacagtgatagtcatcacattaaagaggttatttgcgatatgaagcttgacgcctgggataaaaacattctgacattattgcaacgcgataatcgtctttctcagcgggaaatcgccgaacaggtcaatctttcaccttcggcagtgaatcgtcgtatcgcggcactggaggaggcgggcataattaaaggcaatgtcagccttgttgatgctggcaaagtgggacgcccggtcacgattgtggtgcaggtggtgatcgaaaacgagcgattcaatttactggaagaggctcgtcaacggtttgtcagttgcccgcaggtgcagcaggtctactacgtaacgggcgatttcgactttttactggtgctcaatgttcgtgacatggcggaatatgaaacacttacccgtgagcttttcttttcctcaggcaatattaagtcttttaaaacgattgtcgtgatgcaaaacgccaagcaagagatgcgcgtcctgatcgagtaacgtgcgcaaagcttacaaaaccagcctaaattctcaattgttcgcgagcaggtgcgaactttttacaggtttctttctgaaaacctgcttccagatgcgatttctgcttgtctgattgcagatgccaggtaacataggaatacccccatttcgggtggacaagtgtttattttttccgactattaactagagagaatattatgagcgttgtgcctgtagccgacgtactccagggccgcgtagccgttgaccaagaagtcaccgtgcgcggatgggtgcgtacccgccgagattcaaaagctggcatctccttcctcgccgtttatgacggctcctgctttgatcctgtacaggctgtcattaataattctctgcccaattataatgaagaagtattacacctgacgacaggctgctccgtggtagtaacaggtaaggttgtcgcgtcgccgggacaggggcaaagtttcgaaatccaggccacgaaagtagaggtcgcaggctgggtggaagatccggatacctacccgatggcggcaaaacgccatagcattgagtatctgcgtgaagtcgcgcatctgcgcccgcgcaccaacctgattggcgcggtagcgcgcgtccgccatactctggcgcaggcgctgcatcgcttcttcgatgagcagggtttcttttgggtctctaccccgctgattaccgcttccgataccgaaggcgctggcgaaatgttccgcgtctcaacgttggatctggaaaacctgccgcgtaacgaccagggcagagtagattttgacaaagacttttttggcaaagaatcattcctgaccgtctccggccagctcaatggtgaaacctatgcctgtgcgctgtccaaaatctatacttttgggccgaccttccgcgcggaaaattccaacaccagccgccacctggcggagttctggatgctggagccggaagtggcgttcgccgatctggaagacaacgcccgtctggcggaagccatgctgaaatatgtcttcaaggcggttctggaagagcgtgcggatgacatgaagttctttgccgaacgcgtggataaagacgctatcgctcgtctggagcgttttgtctccaccgactttgctcaggtggattacaccgatgcggtcgccattctggaacgctgtggtaagacatttgaaaacccggtgttctggggcgtcgacctttcttccgaacacgaacgttatctggcggaagagcatttcaaagcgccggtagtggtgaaaaactatccgaaagaaattaaagcgttttacatgcgccttaacgaagatggcaaaaccgtggcggccatggatgtgctggcgccgggaatcggcgaaatcatcggtggttcccagcgtgaagagcgtctggatgtgctggatgcccgtatggccgaaatggggctgaataaagaggattactggtggtatcgcgacttgcgtcgctacggtactgtaccgcattccggctttggcctgggctttgaacgccttatcgcttacgtcacgggtgtgcaaaacgtgcgcgatgttattccgttcccacggaccccacgcaacgccagcttctgatttttacgtcacactcaaggccagctatgctggccttttttttcgcctgaatgtcagttttattatcaataagtaaataaatttaattacaaccctctgaattacaacatcttgttactgtatatttcacgaaaatatttacacataaaaattaatccttaattttattgcggattagatttttctgctctaatagcacaatttttcaccacaatttcggacatcaagacttctaaatggctatttttatgaaatagctcgtctgctgttttttcaggcacaacggtgtcgcaaaccaataaatgtaataaaatcatagtgataaaataaaaataatcaaatcaaagcgagaactcaggggaagtttgacgttgttcacaaagttccgcgaaaataacatttatttacatatttttccttttgaaaccaaatatttatatttgtagcactttcacagtagcgaaacgttagtttgaatggaaagatgcctgtcagacacataaagacaccaaactctcatcaatatttctgtaaagttttattgacagaatttattgacggcagtggcaggtgtcatataaaaaaaccaatgagggtaataaataatgatgaagcgcaaaatcctggcagcggtgatccctgccctgctggctgctgcaaccgcaaacgcagcagaaatttataataaagatggtaataagctggatctgtacggtaaagccgtgggtcgtcacgtatggacaacgaccggcgatagtaaaaatgccgaccagacttatgcccagattggttttaaaggggaaacgcagattaacaccgatctgaccggtttcggtcagtgggaataccgtactaaagcagaccgcgctgaaggcgaacagcagaactcgaatctggtacgtctggctttcgcgggtttgaaatacgcggaagtgggttcaatcgattatggtcgtaactacggtatcgtttacgatgttgaatcctataccgatatggccccctacttctccggcgaaacctggggcggcgcctataccgataactacatgaccagccgtgctggcggtttgttgacctaccgtaactctgacttctttggtctggtggacggtctctctttcggtatccagtatcagggtaaaaatcaggacaaccacagcattaactctcagaatggcgatggcgtaggttacaccatggcatatgagttcgacggctttggcgtcaccgcagcgtacagcaacagcaagcgtactaacgatcagcaggatcgcgatggtaatggcgatcgcgcagaatcgtgggccgttggcgcgaaatatgatgcaaacaacgtctacctggctgccgtatatgctgaaacccgcaatatgagcattgttgaaaatacggttaccgataccgtggaaatggcaaacaaaacgcagaacctggaagtggtcgctcagtaccagtttgacttcggcctgcgtccggcaatctcgtatgtgcagagtaaaggtaagcagttgaacggcgccgacggctcggccgatctggcgaaatatattcaggcgggcgcgacttactacttcaacaaaaacatgaacgtatgggttgactaccgtttcaacctgctggacgaaaacgactacagctccagctacgttggcaccgacgatcaggcggctgtcggtattacttaccagttctgatcagcagacccctttgttttatgcctcaaaaacaggacttcggtcctgtttttttatctctcttagagaaaatgtgcgtctttcaaaaacaggcgggctttttagcgctaacggttggcattttgtaaatctgccgttaacctgatagcggatttcccttctgtaactataatggaacctcgtcatgtttgagaacataaccgccgctcctgccgacccgattttgggcctggccgatctgtttcgcgccgatgaccgtccagggaaaattaaccttggcattggcgtatataaagatgaaaccggcaaaacaccggtgctcaccagcgttaaaaaagccgagcagtatttactggaaaatgaaacgacgaaaaactatctcggcattgacgggattccggaatttgctcgctgcactcaggaactgctgttcggcaaaggcagcgcgctgattaatgataagcgcgcacgcacggcgcaaacgccgggcggtaccggcgcgttacgcattgccgccgactttttggcaaaaaatactccggtaaaacgggtgtgggtgagcaaccccagctggccgaaccacaaaagcgtgtttaacgctgccggcctggaagttcgggagtacgcttactacgatgcggaaaatcactcgctggattttgaagcgctacaagccagcctgagcgaagcacaggccggcgatgtggttctgttccacggttgctgtcataacccaaccggcattgaccctactctggaacagtggcaggttctggctgagctttccgttgaaaaagggtggctgccgctattcgatttcgcctaccagggctttgcccgcggcctggaagaagatgcggaaggtctgcgcgcctttgccgcgctgcataaagagctcattgtcgccagctcctactccaaaaacttcggcttatataatgagcgcgtcggcgcctgcaccctcgttgccgccgatgcggaaaccgtggatcgcgcttttagccagatgaaatccgccattcgcgctaactactccaacccaccagcgcacggcgcgtccatcgtcgcgactatcctgagtaatgacgccctgcgcgctatctgggaacaggaactgacggacatgcgccagcgtattcagcgtatgcgtcaactgttcgtgaataccttgcaggaaaaaggcgcgaaccgtgacttcagctttattatcaagcagaacgggatgttctcattcagcggtctgaccaaagatcaggtgctgcgtctgcgtgaagagtttggcgtttatgccgtggcttctggtcgcgtgaacgtggcgggcatgaccccggataatatggcgccgctgtgcgaagccattgtcgcggtactataaaaagctgccgactggcgtgaccgataaaaaagcctgcacattgcaggctttttcattctgcttaccagaccggcatctcatcttgcaggaaggaattatgcagacgctcgtatccgagcgtagagagcgggccgtggccaggaataaaggtcacatcatcgccaagcggcaataatttacgcttaatggcgtcaatcaactgggtgtgatcgccgcgaggaaaatcgctgcgcccgacgccacctttgaaaatcacatcgccggagatcagcagttgcgactgttcatcaaagaaaaccacgtgtcccggcgtgtgtcccggacaatgtaacacctgtaacgtcacattccccacgctgacgcgatcgccgtcgttcagccagcgatcaggcgtcagcggctgacactcatccagaccaaacatgcggctttgcgccggcagtccttgcagccagaactcatcttctttttccggaccgataacaggaacgccgtaatgctgcgccagttcactcgccgcgccgacatgatcgagatgcccatgcgtgagtaaaatttgcatcaacgtcacgccgctggcgtccacttcctgtttaattttttccgcgtcgccgcccggatcgaccagcgccgccagccgggtttgttcgcaccagattaatgaacagttctgggagaacgcggtgaccggaataatacgatagttcatactgctcctttgattaagcctcgctgattaccagtgccgcgctggcccggtatcaatatgcacaaagttactacgtgggtaatatcctacaccacctgcgcgcatagataacgccgctttgcgaatattgctcagcgccacgccctcaatatgaaaatccatcgcctgcccttttgtatggtagctttttttcgctacgccgctgctacgggcgcgtaattcattattggtatcaagagaacggtagcctgagatgagctgcacaggtttacgcgtccctaacagcccctgaagtcggtaaagttggtcaaacaggcggggatcgattgatcggactttattcgcgcgatagtcacggaaaaaatggtttaactttgctaattcatcctgaatgtaggctcttccatcgaaaaactccgccttgattgactctccggtatggagattgtttaacgtcaaaatgcgcgggcgtggggtcgagagtgtggcaaacgctggcgagggcaggatggcggcgccgagagcgacaccaccaagcgccagcagcttgcggcgattagcgtcaaatttgtccatgataatcaggtctacaggtcaatgttatcgttaatacacttctacctttaagcagacatgataccggctggcacagacttctgaacggcccggtcgacttaaaggttgttgtatatgcacttctggcgcacgaaaggcaccttaactggcgataaagcccgcgtcaagatggccctcccccagccacaacgggggtctacagcgaaacgccccgttgaagccaaacattaggacaacatatttaccagaacttcttcatttacctgattaattgttcaacctttggcacaatttgtgcgctggatcgcgctgtgagatcgtaattgtaaatatctgtacgatattgcatacgtccatctgcgccgacaaacgcggtcagatagtaaagatttactggaatgttctgccggatattgacataccgcgtgtcgccttgcttcagggcgccagagatccgcgcatcgttccagccagcatcctgcaaaagcatattcgccagttcagaggccttattgacccgcacgcagccggaacttaacgccctggcgtcacgctgaaaaagattatggttaggcgtatcgtgcagatagatcgcatctgaactcggcatattaaatttataacgccccagcgaattgtgcgcgcctggcgcctgctggaaacggaacggaagattcgatggcgtaatggtggcccagtcaacctgccacggatcgatcgcttctttgctgttccagccgcgcatcacggtgtagccatggcgctccagatagcctgggtcattccacaccttcggtaaaatgtctttacgcgcaagcgtgggcggaacgttccacggcgggttcaccaccacattattcagcgcgctgctcatcatcggcgttttacgatcgggacgcccgacgatcacccttgaagccagcacctggttgccattctgatagtagaccagcgaataagcgggaatgtttaccataataccggtagagagttccgccggcagcaggcgtaaacgttggatattcagtgccagtacgcctgcgcgttgcgcgggggtcatattaagccagttacgcgtcgccgggccaatgacgccatccgcccccagtccttgccatgcctgaaaacgctttaccgcctcgaccagttcacgatcgtaggcgcgtgccgccggagccggcttactacggcgggccgttggttcgtcgaccggctgcgccaccgatgtttcgtcgactacggcggaggggctgacgacggcactatcagaggtgttatcgccgggtaaggctatctttggaccgccatccagcatccccgtacgctgtaatatttcgcgcagcgcaggcacatcgttactccattgccccgggcgcagcgtcgcggtattggtcaactgcggccacgggcgagagtccgccaccagcttcagcagtgcgtcatgcatgggcgcatactgtggatgctgcggcgccaggctggcgacaaacatcggcaactgcccctcttccagcgcgatttgccactggttaatcaccgagactggcggcgtcgccaatgcgtaaggtttgttgctatatagccagcgttggcctttgacggggatattcgcaatgaaatggagatagcccatcatggcgtctgacaacacaacatcgcgcgccataccgtttacggcgggagcggtcaacaatgccacccaggcggtaaactgcggctggaatccggcgatcgccacctccgccaactgttgctggaaggctttcaccgcatcgcgattatcccacatgggcttcatgtcgcgcgcggcatacagcaatgtcagctggctcatatagaccggcgtatagccggaaggaagctgcgactgtaaatcagcccgaactttctcggctgaaacgccctccggcagcggctgaatcccggccagaatcgccgtcgcggcggattgcttctgcggcccagcctgacccgtcgcggcaacggcgctatcgccaggtatcatttcaggctcatcggcctgcgcattgaacagtggagcgaatgttacggccaggcataaactgattgccgacagacaacgaccacacatcttattaagcaacatcccttgccccctgttttcgttatcatactccgcatgactgtgctgcccgcagcgcgggtcaacctcaaccaatgcttttgtttagtatgacgagtcagcctgctcactcgtcaggcttaactccagtatataaagttcgttacgtttttgcctaacctaatgtaaagaagtttaaagaaaatacactacccggagagatttttcagataaagaaaaaggcggctttcgccgccccaggctaatgataaagcagaacttgttatgccggatgccggcataaccgacttatccggccttgcctgataagcgaggcgccatcaggcacttcatcgtttctgccgtgtttaactcgcttctgaaggcgtatcttccgcctgcgtaccgggaagcgtttccggaagctgcggcgcaaagccacgcagcccgacaacatgaacatgctcagtattctgaaacactttacgcaccagtttatacgtcgtgcccttctccggactgatgttttccggcgcagcgatgatgagctgcatctgcaaacgttcgcatagttcaaacagcgtggcgatagagcgcgcatccagacgcgccgcttcatcgaggaacagcaggcgacatggcgaaatatctttcccgcgcagtctgcgcgcttcgtcttcccagctttgcaccaccatcaccagaattgacatccctgttccgatagcttcacccgttgatagcgcgccggattccgcacgcagccagccgtcagacccacggttaacttcaacttccatttccagatagttacggtagtccagcaactcctcgccgatggtctgcggcgtgcgttgacccatatcgatctgcggattcaggcgctggtacagtttcgccagcgcttcggagaaggtcagacgattgctgttaaacagatcctgatgctgctcctgctgttctgaaagcacatccagcaaggtggcatgcgtttcacgcacgttgacgtttaaccgcacgctattcacctggccaaacgagacgctttgcaaaccctggttcagcatacggatacggttctgctcacgctggatagttttgcggatgatgtttgccacgctgcgggaactgatcgccagcttttgctcacgcgatgtcagctcttccgtcagacggctcagctcaatctccatttgttcaatggcttcaaccggatcgtcggtacgaataatatcctgacgaatacgctcgcgcagatgctggtaaacggccacaaagaactggattttacgttccgggcgtttcggatcttccgacagacgcaatacgtcgcgcagatgttcgttatccgcgacggccagacgcagcgcgcccaacgccttatccgacatggagcgcagttcatccgccgacagataagccagctcacgacggtgcagacggcgttccacgccattgtctttcaccatccgcatgaccgcgcaccagccggctttcgcggtcacgacctgctcgcgcatttcatgataatcgcgctccagcttgcgcagcttacgggtcaggttctccatctccgcttcgcagaaggtgagcgctttctcaagctgattgcgacgcgaacggttattgctcaactgagcgtgcagttcatcccgacgctggcgggcgcgctcttccgccccgctgtcggcgcgaacgccaatgtcctgtaattcgcgctgcaaatcgttaagcagctcttttttcgtgtcgtaagagctttttagcgaggccagaacctggctgtactgacttaactgcgcggcatggctgcgcagcgcttcgcgggcgcgggtacgctcggcttccgcctgctccagccgctggcgcagcttttcgttgagatcgctgttgccgctcagcatttccgccgagtcggaatagctgaaatgcgcccgacgttcgacaacttcagccagagcaaaagcctgctggcgcgcgtcgcgctgcatttgctgcgaccatgcatagtcttcttttaattgctcaaactgttccggatcgctttgcagaacggaaaccattggctccagtttggctaactggttgccatattgctgcacaaatcgcgccgcttcctgcgcctcatccaaccgctcctgaatttcatcgacccgatcggccagcgtttcatcggccaataaattcagccgcggcagcaaacggttaagcgcggaaacgccctctttggcctgctcaaactgaaggcgctgctgctggttgtcgctttcatgcgtcgccagcgcgcgctccagctcgacgcgacgcccgttcagtcggcgaatttccgcttccggatcgtcctcaaaggcaacggaaaggtggctaccgataaaacggctgaacgcctggtgcaaacgctgggttttctgcacgtcaaacgagagcgtggcaaagcgctcggaaagcacttcccgttccgcatggagactctcaatacggttctcgcgcgccgcgcggccaaaaataggtagcgacgggaaacgcgaataacgccactgacggtcggcaattttcacgaccaccgccttttccagctcgtcaacgctgaatacgctgtcatcaaaagactgcggatcgccttcgatcaggtacagatcttccgggcagtcggtcagaccttcaagctgttcggctatttgcgataaatccggtacgacgatcgcatggcgcgacgggccatacagtgcggagaagtacggcgcatcttcaagactgacatcgtcgtagatttccgacagcagtaccccgccaaaacgctccgccagcgcattcaaacgctgatcttccgcaccgcccggctggcttaaacgttcgatctcttcatcaaccgcatttttacgtgcgcccacttcgtcgcgttcgacaatggcttcgcgctcacgctccagtagctgttgcaggtattcggtcacttcctggctggacgtaaactcctcgccgcactgttcgctaagctggttcaggctattctgcgccgccagccagacaggagcgcgttgcatcagatgctggatacgggattgcagctgttcctgttcctgacgcaaggccatacgctgttcgctggctgacgacacgctctcagacaaggacgcgatgcgggcttccagctcctgatgcagcgcttccagttcgtcaatatcaaaatttttgccctgtcgcttacagaactccgccagcagacgttccgcctcttgctgctcgcgcagccgctgttccagttcgctcaggcgcatccgcagcggctgtacctgttccgccagatgacgctggttcacgccgtcccgtaacagctcgcgcgccacgtcccaggcttcgctacgcgccagcgggccgttgatcgccgccaccagctggtaagcctgctcaaactggctgtgcgcggtttgcgccacgctcattttttgttccaacgacagcagtttttccgtagcttcctgctcttttgcctggaaagtatccagccattcggcggcgctttccggcgttagatccggtagatggcaaagttctttagcgcgggcaagcgctgatatcgcctggttatactgaatcgcgcgcgtttgctgtacatccagcgcctgctggtaatccgcaagctggcttttgagttcatcgacttccagctcggcggcttcggcacgcgcttcattttcgtcctgcatttcggcggcttccgccaccacttcattttgctcttcgaatcgaatctgcagctcttcaagatccgcttcgtagcgttcaattttttcctgctggcgcagcgcggtttgcaccagattcaggtgatcgctcgccgcctggtaatccgcttcaagagaaccttcggcgccgttatgttcgcccaactcacgggccatatcgacgtgcttgtactgctccgccgccagttgtttgcgcgatgtgtacagttcgcgtcgaaacgccaacgcctgatcaaggtgaacccgacgctcattggcgtggcgcatataatccgccgccacataatcggtggcttcgctgatcaaatgcttaaacagatcgcgatcggattgggtaacacgaatcgcttccagcgtgagtcggttctcgcgcagcgccgcttccatatcctggaacgccttgcgcacgccgctgttttccggcaataaataatcgcgtagcgatcgggtaatggcgctggagatcccgccgtacagcgaggcctctatcaaacgatagaatttactacgatcggaagcggaacgcagacgacgggcgataatccctaagtcaaacatcagcgaatgataatcggtgatggagttaaactgcttaaactgcacgccttccatctcgtcaagcttgtctttcagctcagcaagcgacagtacgcgcgcctgacgttcgtttaatgtctccgtcaccagttgtgtcggctgtaccgacatcggcagcccctgaatagcgaacggtttgatgtccactttgcgatcgcgcccagcgacctgctgcagacgcacgccgaccaccacccgctgatggcgggaattaatggtgtcgagcatggagtaacagacacccgccttcagcttaccgtgcagacctttatcgcgcgaaccgctggtggcgccggcttccgtggtgttacgaaagtgcagtaatgtgagatccgggatcagcgccgtgacgaacgccgccatcgtcgtggatttcccggcgccgttgcccccggataacgtcgtgaccagttcatccaggtcaaaagtgcgggcaaaaaaaccgttccagttaatcagcgttagcgagcgaaatttaccgcgttcaatcattattcttcctctccactgtccggctgactctcttcggtctcatcattaagttgcagatggttttcaatgggcatcgcttccccgtcgcggatgagacgacgctgcgcctcgcgaggatcgtcgccggcgcggacatccgcgccaaagcggaagaccgattcggtaatgcggaatttgctgctgtcgtggcccataaaccataccatgcccaaacgacgcaggcggtttaaagaagaacgcaccttttcctgcagtttctgacgatcaacgtcagatcccgtcgaacggttattcaccagctttagcagtttggcttcgtccgcaagggtaagcagctcgtcgtacaactcctgctgagtaaagatcccttcgttggccagacgctccgggctaagatagaggtagcagagaattttaccgaccatcatatccagttcggataacaccgagcgcgggataagcgtggtagaacgcggacgcaggtaaaagaacccctccggcgcacgaatcaactccacgttataacgcgcgtaaaactcttccaggtattcctgaaaatccatcagaaaggcatgattatccagttcgtccagcccgatgtggcggcccgaacgtaatgcgctatccagcgccggaaataacggattcgccagcgcctgcgccagcttaaccggcatcacttgttcaatatttgtcaatgacatgcgcctgtaccttggctccgtaatcattaatcggctgccatttggctggcagtccggtgaaatctgcttgcgctacgccaagacgtaccgcttgatcgataacaatacgcgccacgtcgaaatgacgcgcgcgcgggtattgcgccagatactcgcgcaccaccagcccaagatccagtggcgtttgtctggttttgtagatagccagctgttcttcaatgatggccgctaactgctcgcggatctcgttaaactcttcatattccagatccggcggcaactccccggtgacttcatcgtcacgcaacgccatctcttcatcgcgcatatccagcagacgatcggcattcgcgtaggttagcgcccacggatcgtcaaaataagtctgcacggactggcgcaaccgctgggcgaagatacggtttttatccatatcgatcgcggtacggataaatttatgcacgtgacgatcgtagccgatccataaatcaatagactgctgaccccaactgataatgcggtcgagtttactttgtaagtcaaacaccagcctgtcgacaaaatgcagatcgtcgtgcgtcatcgtggcatcctgaatgcgcagcaggttagcctgcagcttatcgcccgccgcctccagcgtatcctgcaactcgcgcagcgtaccggacgtttcggaaagcagcagctcacagctggaaatcgccgcccgccagtctttattcagcagttgtgcgatatcgtctttcacctgctgctgctgttcatccataatgcgctgggtgagatcgatactgtcgaaaatctccgccaccgaatatttcaatggcgcgtaaacattgcgatgccagtggaactcatcgcccccctccgctgccgcatccgccgcgcgcttcaattcgccggccacaatcgacaactgcatagaaagacgcagcgtagagaattcgcgttgacgaatgtagtaatcggtgatgccaatcccgagcggggttaatcggtaaatcgcattgccttccgcctgctcgctggtaaagcggttcagcagacgttgacgcaccatatcgttaatcgcgttgttcgcgcgcacgccgatggtttcgctggtttgctcaaacgcatcactcacatggcggaatgcatccaccagctcgccttcactcatctcgccgtcaaggcgttcgccgttcaacgtggcgaccgccagcagaaaggaaagtctgtctaccggcagcgagatggaaaagtcgttttttctggcccaggcaaccagttcggggactgtctgggaaaattcactcataggttatccttgcatctgcggctagcgccgggcttttaatcgcggtgacatgaatgtagcgcccaaggctaatatacggctcctggcggcaataacgcgtttccagttcgaccagggtctcataacagtcacgctgctggtgtttttcacgcagataatcatgaaacacacgcacgccggttttaccggtaatctgccagccaatcgcctccagccactggtacacctgcgcggggtcgcgcgggtagtcaggcgacagcgtgcgcttcttgcgtttaggcatccccgcctgcacgtagtcaaaattacccgccaccatattgtgcatcagcaaaccgttagcgttatagaacatcaacgacagcgcgccgccagggcgcaatactgaccagagcgtttctaatacgccgacaggatcggctacccactccagcacagcatgaaacaatatcagatcaaccgggctttccaaatgcgaagcgacgtcctgagccgggcattgtataaaatgcatgtctttgctcacaccttttgcctcggccgcctgccgcgcgcgggcgatcatttcgccagacagatcgcataacgtcacctgatggccgcgttccgccatcttaatcgccgtttgcccttcgccgccgccggcatccagcacccgcagtttccgcccgccaatctcctccagcacgcgatccaggtcttgccacagaatggcttgccgcagttgccctttggtcgtgccgtaaatgttacgggaaaacttttcagcaatgtcatcaaaattgcgatcctgcatcggactctccacaggctggctcaggcgttatctgataaaaccgctattttgtcacagccgcggcgagaatgaacctgtctggtgtaatatcaccgttaatcctccgctatatggttaaaaaaggaaccaaaaaggatgctttttacgctaaagaaagtgattggcggcatgttattgccgcttccgctgatgttgctgatcattggcatcggcctggcgctgctctggtttagccgctttcagaagaccggaaaagtatttatcagcgtaggttggctggcgctattgctattaagcctgcaacccgtctctgaccatttgctgcgtccgatagaaaaccgctaccctacctggcagggtccgcaaaaggtggaatatattgtggttctcggcggcggctatacctggaacccgcagtgggcgccgagctctaatttaattaacaacagcttgccgcggctggcggaaggcattcggctgtggcgcgcgaatccgggagccaggctgatttttaccggcggcgtagcaaaaaccaatacggtaagcacggcggaagtcggcgcgcgggtggcgcagtcgctgggcgtaccgcgtagcgatattattacgctggataagccaaaagatacggaagaagaagccgccgccgttaagcaggccatcggcgacgcccctttcctgctggtaacctccgcctcgcatttgccgcgtgcgatgattttctttcagcatgccgggctgaatccgcttcccgcgccggcgaatcagttggcgatcgattcgccgctcaatccctgggagcgggcaattccgtccccggtctggctgatgcacagcgatcgcgctgggtatgaaacattagggcgactttggcaatggctgaaaggcatatcaggcaagccaggggagtaatgatttcgccgccagatcaaaattggtacggttaaaacgtccggtattgaccaattgcgcaacctcgtcccacagcacatagagccaacgccgccagatgaatgactccgccactggcgcgcgttgcagataatgccaaagcaatccctccgccaatggattatccatcaggcgaaacagttcgaattctctcggcgcccacagcatcagcccggggccgaccatcgccagaagctgatcgctacgggcgtctttaagcatactgcgcaagcagaagttgccatgcaccagtacgcagttgtcgttaaacccttcaaataacgaaggaagatattctctggtacgaaacagaatgcgtttgtcctgcatcgtcaggccggtattgctgaactgatttagcgtcgtccacagcacctccacacgctgacgataccaggaaggccagatattctcctgagtatggtctacggcgcccacgcaaccgcggctatcctgccgatgccaggctaacaatccttcgacaatctgatcttttagctgttcccagcgttccggagtgcgcgccggcgcctcgaccggcacaccgcgcagtcgttccagtagcagcacatccagaccaggatgctcttcatgcgtcaatacgccatagattaccggcatcctcaccgtaccgctacgcgccagcattgaggttttccatgccagttgctgcgcaacgccaggagtggtaaaacttcgcgccatcagcggcatcggatttccctggctgtcatataatgaccacaatgcggaatccgctttctcattcacgcactctatacggctaagtttttcacccaacaaatgactgagttcggcccgcaactgttccattccagattacccccattagtgctactgctttaataatgagcgtcgtatggacagatgtcacccgtatcagatcaagggaagaaaagaaaaatgaggaaaatcgtaacggtacgagaaagccgccactgatgagcagacgtgagtattcatctttgcgctatcataccgcgctgttcatgaccgtctaagacgatcatgaacaggatcatgttaacgcatttcagcgcgcacgcgctccaggtcgtcggcggtgtctacgcccgtgccgggcaccgctttggcgacagcgacatgaattttttcgccgtaccacagcacacggagttgctccagcatttcaatatgttccagcgggctgggttgccagctcacgtaacggcggataaatcccgcgcgatagccataaatgcccaggtgacgaaggcaagtatcccctaccgtttccagactttttgcaaagcgatcgcgatcccagggaatcgtcgcccgggaaaagtaaagcgcatagccttcagcatccagcacgacttttaccgcattcgggttaaacgcttcttcggcgctgtgaatcggcaccgccagcgtcgccatgccaacctggcgctgcgccagattttccgcgacctggcgaataataaccgccgggatcatcggctcatcgccctgaacgttcacaataacggtatcgtcggtgaatccgcacttctctaccacttccgccaaccgttcggtgccggactggtgatcggcgcgcgtcatgcacacttcgccgccagccgcttctaccgcacgagccacgtcttcatgatcggtcgcgacaataatgcgttccgcgccagattcgcgcgcccgctccaggacatgaacaatcatgggtttaccattaatatccactaatggtttgcctggcagtcgggtagatgaaaaacgggccggaatgatgacgacgaaactcatgatttactctcatcagatgtcagggcgcgagcttcattttccagcaatacaggaatgccgtcgcgtaacgggaaagcgagattatccagtttgcaaattaattcttgctgttcctggttataccagagtttgccgttacataccgggcaggcgatgatttcaagcagacgatgatccatagttcctccagatggaccggattgtgaatccttcaatattaacataatcggttatggtgcagggtctatttcccagccatgacgcatggcgctaaacaggcctggcggacattgtcccagcgtcacgcgcgatgctcgttgccaggcagcaaacgcgctaatggcctgccagattcctttttgcagactaacgccagggcgaatatcgtcctccagatacagcgagataacctcaagcacccccgttttacggtgcattttggcgtccattcgcccgactaaacggccctggtataatagcggcagcacaaaataaccgtactggcgcttcgccgcgggcgtataacattccagccggtagtcgaatgcgaagagctgcgctgcccgcttacgatcccataccacaggatcgaaaggcgacagtactgcgctatgggtcgcctttaaggcgttatttagcgccggttcaagctgcgaaagaagatcggcatgaagccacatccgccccaacgtttccacctcgaccggaataatctgctgctgttccgcccggctctcccgctatcctttcaggtcaggacgtttcaggcggtagtaatccgccagccactgttcacggaaaatccccagactgcgcgcgctattatccagcatcaggctttccgcctgcggctgtgacagtccatcgcgttcatcatcccagtgcggcatcacacggggcgttaaatcatatacacgttgaaaattacgccgctcaacaaccatgacttttccggcggtaaataaaccctcaaggtggcgtttatgtggtttccattcccaccagccgctgacgcctttctgcgcatgttcaaaatcggcagaacgcaccggaccatgctcctgaatatgccgcaccagctgttctatttcttccgcgtgctcatgcatccatgccgcgcgatatttccagcccattttttccggcgacagcatacgatggcggataagtttaaagtcgcggcgtggtaagaaacaggcctcatgcgcccagtattctattaactcgccgcgtcgcagcgcctcatccagccaggcctgcgggtacgaaccgagacggctaaacagcaccagataggggctacgtgcgacaacattgatggtatcaatttgcagcaacgccatgcgtgagatggcggcaagaacatcgccaggcatcgcgttacggcgcggctttttcaatagcccctgcgcagcaaggtgaagacaacgggcctgggaaagagaaaggtacggcaatgacattcatgactccataaattcatcactgccgctgcattggggtacgctagcgaaccagcgaggtgatatgttcaagcaacttatcaggctgctcgccggacaaacgcgcatcaaccggtaagaaccaccagttatcttcggcgaaagcacggcatttcaccgcgtctttttccgtcattaccagggtctgcccttcaccgaccaacgcctgaacgtcagcaggggcgagcgtttgatgatcggccagcgggacgcacttttgcggatgcgcgccacaggcttccagcgtggcgaaaaagcgcggcggatgaccgatgcccgccatcgccacaatattgctcagttgcgccacatcgcaacgcgctcccgtacgtaagttcaccgccagtccaggcgctagctgcatggggatttcgcccgcccgggcgacgccgccattcacgatagcggcgtccacggttttcaggcgactggcgcgttcgcgcatagggccggcaggaagccaccagccgttgccaaaacggcgcaccccgtcaatcaccacaatttcaatatctcgcgctagtcggtaatgctgcaacccatcgtcggtgataataatctgcacattatgcgccgccagaatcgctttcaccgccgcggcgcgttcaggcgccaccgcgacaggcgcgccggtccgctgataaatcaataccggttcatctcccgcttctgcggttgtcgtctcaggcgtcaggagcagcggataagcggcagctttcccgccgtagccgcgggaaacgacccccacgcgcacgccacgctgttgcagcttttccaccagccaaatgactacgggtgttttaccgttaccgccagccgtaagattccctaccacaaccaccggtaccggcgctcgccaggcgcgtttcaaaccaagcttatagctcagacgaatcgccccgctcaccaggccatacagccaggagagcggcagcagtaaccgccatagcggggattcacccgaccagatacgcgcaatcattggccaaattgcatcttatgcagctgggcgtaaacgccgtgttgcgccagcagctcgctatgagtgccgcgctcaacgataataccgtcttcgactacaacgatctcatccgcctgttcgatggtggagagacggtgcgcaatcaccagagaggtacggtttttttgcagctcatccaacgcggcctgaatcgcacgttcggactcggtatccagcgcggacgtagcttcatcaaggatcagaatcgggctgtcgcgcagtaaggcgcgggcaatcgcgatacgctggcgctgaccgccggaaagcagtacgccgttttcgccgataatggtatccagaccattatccatcttgttgataaagtccatggcataggccatgcgcgccgcctcttcaatctgctcgcggctgtattcttccgtccgggcataagcaatgttattggcgaccgtgtcgttaaacagatgcacgttttgcgaaaccagcgccacctgattacgtagagaggccagagtgtattcgcgtagatcgtgaccatccatcaggatgtgtccttcatcaatatcgtagaaacgggtgatcagactggcgatagttgatttacccgatccggaacgccccaccagcgccacggttttcccggcaggaattttcaaattgatgttacgcaatgccggcacttcacggcccgggtaagtaaacgtcacattgcggaattcgagatcgccggtcgcgcggtcaatgacacgtttaccttcatctttctcctgttcgctgtccagaatcgcaaacaacgtctgacaagccgccatcccacgctggaactgcgcgttaacgtttgtcagcgattttaatggacgcatcagcgcgatcatggaggagaacaccaccgtgatggtccctgccgtcaggctatccattacgcttgggaagctcgcagcatagagaacaaacgccagcgccagcgaggcaatgagctgaatgataggatcggaaattgacgaggcagagaccattttcatgccttgcagtcgcatcttattgctgactttatcaaagcgtttagtttcgacttcctgaccgccgaaaatcagtacctctttgtgtcctttcagcatttgttcagcgctggtagtcacttgtcccatcgtgttctgcatatttttactgatgctgcggaaccgctttgagacaacgcgaatcgcaatcgacacaatcggcgctaaaacaaccaggatgatcgacagctgccagctgtaatagaacatcataataaacaatccgatgatcgatgccccttcacgcaccacggtaatcagcgcgccagatgaagaagaggcaacctgttctgaatcgtatgtaatacgcgacagcagcgtaccggtagactgtttatcaaagaaggcgacgggcattcccatcatatggccaaacaggcgacggcgcatggtcattaccaccttgcctgacacccatgaaatacagtagctggagatatagctagtgatgcctcgtaatatcatcagcccaataaccaccagcggcatccacagcaacactgagcgatccgttttaccgaaaccatcatccagtaatggcttgaggagcgatagcatgaaggtatcgctggctgcgttgagaattaacgctatgcccgccacgatcagacctgctttaaaaggcgctatggttggccacagtcggcggaaggtctgccacgtagagagatctttatcgttatgcattcaaaaaaccagcatttgttgaaatagccgcatattctacccgttatcctcggacacgccaaaccactgatgataccagcgaggtaaaatttgatcccgtaagccttgtatgcgccagccctgcggagaaaacagcagcgaaatttgcccctggtggggtgtatcaaaccactgatacgcctgctgtcggtagcgctgttttaccttgcgggacggcagccgccatgcgttatagcgcgatgcggacgccagcgccgcttcaccatgtacgcgctgaataaatggtaacgacgacgacgtattactaccatgatgcggcacctggataaacgtcgccgcaagatgtcgccagtaacgacttagcattttttgttcagcgcccgcttcgatatcgcccgtgagcaggatgctatgtacaccgtcatccactttgaccacacaagaacggttatttcctcgatcggcactttcgcgtaacggccagtgcgcctgaaacgttagcccctgccattgccactgctcgccgcgaaaacagggcaaatgtccctgccagcctaacgggctgcgaatccacattgacggccagacctgctgtagcgaacgcagcccgccccgatgatccagatgctcatgactcaaaataacgccctccggcgtcagattatgccagcgcaaccagggaataataacctgttgcccgctgtcgccctccggccatgcccgaccggtatcgtagagtattactttatcgcccctgacgatcgctatcgccagcccctgaccgacatccagcatatgcacctgccatccgctggcgtttatcggccgccagagtggccagctcatcaacaataacccgcataaacagaccgccggccaggtacgccagacgtttaatcgccacgcgataagcgttagccagggtaaaagcgtcagccactgccaacggttatcaatattcacccagccctgcggtaaagcattcaacaggtaaaatagcgcggctaacgcgcgatcggtcaggtaccatacccactcttcaagaaaaaacggcccggttaaatgcagaatcattcccgccaggatgagtggaaccgtcacaaatgtgacccaaggtacggcaaaaagattcgccagcattgcggtaacgcttatgccatgaaaaagcgccacctggagaggcaaaagcagaagtgtaatgcctgcctgtaggtgaagcaggttaagcaaccagcgtaagcctcgtggaaaatttccgtttggcgcaggaaaccactgataccagaataacaggccggcaaccgcaaatgctgacagccaaagactttgtgatataaccgccacaggatcggcgaaaataatcgcggccagacagcagcaccagacttgccagccgctccactgtcgtccgcttaatttcaatcctccccagacgctcagtgccgccaccgtgcgcagcgcaggcggttgtaagccggtaagccaggcataacatatcgcgcaaagaatgccgcccagcaatggcgtctgccaacgaatccatctgaccggcaaaaagaattgtccgccacggattaatccggcagccaataacgcagcaaaagcgatatgcaggccggaaatcgccatcaaatgggcagtccccgtatcgcgcataacggccttcacctcctgcgacaccgctccccgctcccccattcccaacgccagaataacctgctgccacggataaggcgcaagcgtagcgcgaagcgaagcaagatagcgcccacgcaagctacactcagggttaatcgctttagcctgtagaaaacgcccggtcaacggttggtgctgcgccagcgcgtaacgctggctatcaaaaccgccttcgttaagctgtccgtgtaccgctctgaccttcagcgtcatcgcccactgctgtccggcacacacttccgtgggtaagtactggccatgcaggacaatccctacagcaggaaagagtggctttccatgcaaatgggtaattcgcccataatgagtggtcatatgatcggtggcagtaatgacgactgtcgcctcctgcgtcgcggcgggcaggacgtttcccacccagatggcctgcctggcggcaaaaatcccccacatgaaaaagagcaaggttaatgccgcgtagcgcgcatagtgatggggtatgaggcaaagcaaacatgccagacaaaacagcaccgcgagaatccacgtatcaggtaatactggcaatatcatgagcggaagtatgccgcatactacgcatacgctgaccgtcgttatcttcatagacacctccctgtgcgggaaagtgtgcaggttcaggacgccattgtctggaggggattttgtgctatacggcgcggattccaggttttttacctgataaatgtaagacgcagcaaaaaatgcgaaacgttttccagttttcggtcgaatagcgtttgcgcctgacggcgtataaatgaaaaaagcaccctgacggtgcttttttcgggttcaagttttgcgttaaaacttaaccgtaaatattggcgcgatcgcgcagttctttacccggtttaaagtgaggaacgtattttccttccagttccactttatcgccggtcttggggttacgtccggtacgaggcgcgcggtaatgcaaagaaaaactgccgaaaccgcggatttcaatacgctcgccctgcgcaagagtcgaggccatatgctccagcatctcttttaccgcgtcttcaaccgccttagcgggaatgtgagattgctgggttgcaagtctttcaatcaattctgacttggtcatgattcctccggttccttaaaggcaaattggctgcagccgtgagattgattaagggcggccgtagccgcccttagtgcttgattacaggccgaaacctgcaatctgtcaagtaatctcgttatacttcggactaaaaggcccgaagtttcagaggattactcgcctttagctgctttgaatgcttcagccattgcgttgttagagaagtttgcatcttcctgcttgttaacagttgcgatggcatctttctcgtcagcttcgtctttcgcacgaacagacaggctgattgcgcggtttttacgatcaacgccggtgaatttagcttcaacgtcgtcgccaacgctcagaaccagagtcgcatcttcaacgcggtcacgggatgcttcagaagcacgcaggtaaccttcaacgccgtcagccagttctacggttgcgcctttagcgtcaactgcagtgactttaccggttacgatagcgcctttcttgttcagagcaacccagttgttgaacggatcttctgcgagctgtttaacgcccagggagatacgttcacgttctgcgtcaacctgcagaacaactgcagcgatttcgtcgccttttttgtattcacgaactgcttcttcgcctgcaacgttccaggagatgtcagacaggtgaaccaggccgtcgatgccgccgtccaggccgatgaagataccgaagtcagtgatagacttgattttaccttcaacgcggtcgcccttgttgtgggtttctgcgaactgctgccacgggttagatttgcactgcttcaaccctaaggagatacgacgacgttcttcgtcgatatccagaaccatcacttccactacgtcgccaacgttaaccactttggacgggtggatgtttttgttggtccagtccatttcggaaacgtgaaccaggccttcaacgccttcttcgatttcaacgaagcagccgtagtcggtcaggttggtcacgcgaccggtcagtttggtaccttccggataacgtttagcgatagcaacccacggatcttcgcccagctgtttcaggcccagggatacacgggtacgctcgcggtcgaatttcagcactttcacgttgatttcgtcgccaacgttcacgatttcgctcggatgcttaacgcgtttccaggccatatcagtgatgtgcagcaggccgtcaacgccgcccagatcaacgaatgcaccgtagtcagtgaggttcttaacgatacctttaacttccatgccttcctgcaggttttccagcagctgatcgcgttctgcgctgttttcggattcgataacggcacgacgagaaaccacaacgttgttacgtttctggtccagcttgattactttgaattcaagctctttgccttccaggtgcagagtgtcacgcaccggacgaacgtctaccagagaacctggcaggaacgcgcgaataccgttcagctcaacagtgaagccacccttaactttgccgttgataacaccggtaacagtttcagcatcttcgtaagctttttccagcgtgatccatgcttcgtgacgtttagctttctcacgagagagcagagtttcaccgaagccgtcttctactgcatccagagcaacgtcaacttcgtcaccaacctggatttccagttcgccctgggcgtttttgaactgctcagccggaatggcagactcagatttcagaccggcgtcaaccagtactacgtctttgtcgatagcaacaacaacaccacgaacgatggaacccgggcgggtttcgatttcttttaaggattcttcaaagagttgagcaaaagattcagtcatgtttaatcttcaggtttcatatttaacgtccacctggctccgtgccggatggggttgtttaacatacccgctgtcaatcctttgcaacgggggtactacaaattcggtcgcatttaagcgagagccaatttttggcgcgcatattgtaacgctttttcaatcacttgctcaatgcttaatcgggtagaatccaaaactaatgcatcagcagcaggaactaacggcgctacagcgcgattacgatcgcgatcgtcgcgttccttgatctcggccaaaaggcgttcaaagttaacactaaagccattctcctgcaactgtagcatacgtcgatgcgcacgttcctccgaggaggcgtcaaggaaaatttttaccggcgcatccgggaagaccacggtccccatatcgcgtccatcggcgattaaaccaggcgcttcgcggaatgcgcgttggcggcgaagaagcgcttcacgcacgcgtgggaatgccgccacctgggatgccgcgttcgcgacttcctgcgtacgaatttcgccgctaacgtcctcgccttccaggataacttccaggttgccgtccgttgagacgaaacgcacgtccagatgggacgccagcggcaccagcgcatcttcagaggcgagatcgacatggtggtgcaatgccgccagcgccagtacgcggtatatcgcgccggaatccagcagatgccattgcaatgcttccgccattgctttgcacaaggtgcctttacctgcaccgcttgggccatcaatggttattaccggggcaattgccgtcatctttatctccttaaacaggcgtaccgttaacgtaaacgccgcgcattatacgcgccaacgctcgcgaccgttaacgttgcgtgcaaaaaccagttttgtctgtaatcagatgcggaataattgcgcaattatagcgggctggcgagaaaccagcccgaaagatgacaatgatttactttttatcttcggcaattctgtcgcgcatatgctgcgcgcgatcggctgaggccgggtgggagtccatcaatgattttgcatgacctgcgtccattatggcgaatttatcgaatgccgtgactaagccctgggtgttaatcccacgttttttcagcagattgtaagagaagtcatccgcatccgactcctgactgcgagaaaacgccaaattgatgacgccttccgccagatcgcccaattgagactgggaaagctgcgctgcgacgccgctggtggcggaaatcgcatcgcgagccgccagcgtggcataggcggtctgcattgccttgcgggagtgccctaaagagacatggcccagttcatggcccagtacgccttcaatttcattatcggtcatcagatccatcaggccggagtatacgcgaacgcaaccgttcgccatcgcccatgcgttgatatcgctggtcatatagactttatagctaaccggcgtaccgtcaatgttgttacccagcgctttagcgattttactcagacgtttggtgtatttgcttttcgaacctgccagttgattctcgctgtccatttgtttacaggcattattagataatgctttaacatccgcatcggacagtgtggcggctttgtaggctgacatgccggaactggcgattaaattgccattcacgccatttttacatcctgccagtagcgtggcggaaatcgccaccgccagtagtaatgatttatttttcatactaatcttccgttgataactattataaaaaacacataaatcaatgtgttaaatcaccaacaaattagcattagtcataattataaaaatagtgcgaatacggactcgacgcgccagcccgtcgactggcgcaacagaagaattaggcaggcgtactcatccgcgccagttgttcgaaataatcagggaacgtttttgcggtacatttagggtccaggatcgtgactggcgtatcggacagtgcgaccagtgagaaacacatcgccatacggtggtcgttgtacgtgccaatatccgcgtgttggagcttcgccggcggcgtgatacgaatatagtcgtgcccttcttcgacttcagcgcccactttacgtagctcggtcgccatcgcgaacaggcgatcggtttctttcactcgccagttataaatattgcgcaacgtcgtggttcctttcgcaaacaacgccgtggtggcaatcgtcatcgccgcatccggaatatggttcatatccatatctatggcgtgcaattcgccgcgcgtgcaggcaataaaatcatcgccccaggtaatggtcgcgcccattttctccagcacatcggcaaaacgaatatcgccctgcatacttttgcggccaatcccggtcacttttaccgtgccgccttttatcgccccagcggcgagaaaataggacgctgacgaggcatcgccctcgaccagatagcgacctggagagtgatactgttgaccgcccttcacgacaaattgttggtagtgatggttcgctatctccacgccaaaggttttcattaaatttagcgtgatatcgatgtaaggttttgataccagttcgcctttaacgcgaataattgtgtcttcaggcgccagcggcgccgtcatcagcagagcggtcaggaactggctggaaacgctaccatcaacctcaatgtcgccgccgataaaaccgccgcgcagacgcaggggcggatagttttcctgctccaggtaatcaatattcgccccaccctgacgcagcgaatcgaccagatggcctatcggacgctctttcatacgcggttcgccggttaacactatctcattttgccccagacatagcgctgccgctaacggacgcatcgcggttccggcattaccgagaaacagttccagagtgcctgacgcgcgtaatgggccgccattacccgtgatatcacagcgggtgcgatcggcagaaagggtgtaattgatccccaacgcgctcagggcattgagcatatggcggacgtcatcgctatccagcagattcgtcagaacggttttaccacaagctaaagccgccaggagcaaagcacggtttgaaacacttttggagccaggtaaattaatggcgccatcgacccgcgcgatgggttgtaacgtcagggattccatgaaactcaactctcaaaaaacagaaataaaaaccccacagactggccgtggggatgaaaaaagaaacgtattagccgtggcggcgctcaaaatcgatcatgaaatcggtcagcgctttcaccccttcaatcggcatggcgttatagatagaggcgcgcataccgccaacaacacggtgcccttttaaggcgtgcagaccagcggcgaaagactcttccagaaagaccttgtccagcgcattgtccgctaactggaacggaacattcatccgcgaacggttggcctgtgcgacatcgttacggtagaaatcgctgttatcaatcacaccatacagcaactccgctttttgctgattgattttgtgcatcgccgccacgccgccctgcgctttcaaccatttgaacaccagaccggaaagataccaggcgaaagtcggcggtgtattaaacatcgagtcgttatcattcaggacggtgtagtcgaggatggacgggcagctctcatgcgccttgcctaacagatcctcccggacgataaccagcgtcagtcctgccggaccgatattcttctgcgcgccagcataaattacgccatagcgagagacgtccagcggcgcagacaggatggtagaagaaaaatccgccgtgacgaccacttccgggccaaaatccggcgtttcatcgatggcgatgccgtcaatggtctcattcgggcaatagtgtaaataagcggcgttatcggaaagctgccactcgcgcatcggttttacggcacgtttgccgtcaacggtgattttggcgtcgataatctgcggcgcacagtattttttggcttctttgatggcgctcgccgcccagtaaccggcatcgacataatccgccgtggttttatcgcccagcagattgagcggcacgccagcaaactgcccgcgaccgccgccgtgacaaaataaaactttatagttggaggggatattaaggagatcgcgaaaatcctgctccgcctcttcagcgacctggataaactctttgcctcgatggctaatttccattaccgacgtaccaagaccgtgccagtcacgcagttcctgttgcgccagtttaagtacttccgccggtagcatcgccggacctgaactaaaattaaagacctgagccatttcccctcaccacgctgcattgtttcctgcctgacagacatcaggcaaacgttattcatgtgaatatcggttttatcattcagtgacacgcgccgcaatgggtaaaacaatgcgaggagaaaatgcggcatgcgtcacacaacagaatcttccggattaaccgtataaatccgatattttcgctgttaaacaacgcgtttagcccggcttgccttcgtccattctggatttgcgcagcgcggacataattgcttctccccgacattcatgcgtatcacttcactgcaacgtacgcaggcatagtcgccagcctccggcgccacgataaagcgtggcgtacagtgctcaggaagaatgcttaaccccggcttaacgtctttattttcaaagaaatagacgctgatttgtccgtttgtctccaggatggccagtctgacctgccccagttgctcaacgccattcaagcgaagctccataaaaaattcaaactccgtcatgttcgagcgctgcagtttttcccacgccagttcgccgtcttcaacaatgaccaccgacttgccttccagcagatcttccaacttttcactatgcgccatcagccacatgactaggcgatagagcagcgccagggtgatgaataccaccagaacagggagcatcggaacgtcatcataaaacgcgacgtcgcctgccgccgatcccaatgtcaaaatgatcagcacttcaaaaagcgacatttgccgtacgccgcgtcgtcctgtcacctttaagaaaagaaacaccagaacaaaggtgtaaaagctacgtagcgccacttcccccaaaaacgctaccgacacgttatccagcgccattcgttgcaaatcaaatgctttcattttttatgctcttcctgtgaattccagtgtaaaagcatagccaatacttttatttccgccgacgtcccggcgagatagcgcccgtcacataaaacccgtatcattgcgcgctttccgtacgacaaaagtgattttcatgacgcaaacatttattcccggcaaagacgccgcgctggaagactccatcgcccgcttccagcaaaagttactcgacctcggctttcacatcgaagaggcctcctggctgaacccggtgccaaacgtctggtcagtgcatattcgcgataaagagtgcgcgttatgctttaccaacggaaaaggcgcgaccaaaaaagcggcgctggcctcggcgctgggcgaatacttcgagcgtctgtcaaccaactacttttttgctgatttctggcttggcgaaacgatcgccaacgggccattcgtgcattatccgaatgaaaagtggttctcgctgactgaaaatgacgacgtaccggaaggcttgcttgatgcccgtctgcgcgcgttttacgatccggaaaatgaactcaccggaagccagttaattgatcttcagtccggcaatgaagaacgcggcgtctgcggcctgccatttacccgtcagtccgataaccagaccgtgtatattccgatgaatattatcggcaacctgtacgtctctaacggaatgtccgccggcaatacgcgtaatgaagcccgcgttcagggactgtcggaagtcttcgagcgttatgtgaaaaatcgcatcattgcggaaagtatcagtctgccggagattcccgcagaggtgatggcgcgttatccggcggtaatggagtcaatcgccacgctggaagccgagggtttcccgattttcgcctatgacggctcgctgggcggtaagtatccggttatctgcgtcgtgctgttcaacccggctaacggtacctgctttgcttcttttggcgcccatcctgactttggcgttgcgctggaacgtacagtgaccgagctactccagggacgcggtctgaaagatcttgatgtcttcacgccgccaacgttcgatgatgaagaagtcgcggagcacactaatctggagacccacttcatcgactccagcggcctgatttcctgggatctgttcaaacaggacgccgattacccgttcacggactggagtttctccggcactaccgaagaagaattcgccacgctgatggccatcttcgctgctgaagataaagaagtttacattgccgattacgagcatctcggcgtatacgcctgtcgtattatcgtaccgggaatgtctgatatttatcctgccgaagatctgtggctggccaacaacaatatgggtagccatcttcgtgagattctgctttcgctgcccggtagcgcctggaataaagaagactatctcaatctgattgaacaattggatgaagaaggttttgacgatttcacccgcgtgcgtgaactgttgggtctggcgaccggagcggacaatggttggtatacactgcgcgtcggcgaattaaaagcaatgctagcgttagcgggcggcgatttggagcaggcgctaatctggacagaatggacgatggagttcaattcgtcggtctttagtccggtacgcgcaaactattaccgttgcctgcaaacgctgctgctcctgtcgcaagaagatgcgcgtcagccgctgcaatatctcaatgcttttataaaaatgtatggcgcagaggctgtagaagccgccagcaccgcgcttagcggtgaagcggctttttatggactaccggctgtcgaccacgatctacaagcgttcccggcgcatcagtccttgttaaaagcgtatgataaattacagcgcgcgaaagcggcatactggtcaaaataaggccatatgagtgacttagggtaggtttaccctctcggctgcgttatattacggggcgcctttgcggccccgttttatttattttcactaaacggcgaaaaatgtaataacaaggttaaatattggttgttgatattaaattaattgacataatgatgttgctttatttgttgattactccatattaattaaccgtgcagcaggaggagccaggaaaaaattcaactctatttataatttttaaaatttatttttattaggataatcaaaaagttacaccgtaattgcataaaagccatgcgacttacgggcctataagccaggcgagatatgatctatatcaaattctcatctataatgctttgttagtatctcgtcgccgacttaataaagagagagttagtgtgaaagctgacaacccttttgaccttttactccctgcagcaatggccaaagtggctgaagaagcaggcgtctataaagcaacgaaacatccgcttaagactttctatctggcgattaccgccggcgtattcatttcaattgcctttgttttttatattactgcgacaaccggtactggcgcgatgccttatggcatggcgaaacttatcgggggtatctgtttctctttgggactgattctctgtgttatttgcggcgctgatcttttcacctctactgttctgatcgttgtagctaaagctagcggtcgcatcacctggggacaactggctaaaaactggttaaacgtctattttggtaacctgattggcgctctgcttttcgtgttactgatgtggctttccggcgagtatatgactgccaacggtcaatggggacttaacgtcctgcaaaccgccgaccacaaaatgcaccacacttttattgaagctgtctgcctcggtattctggcgaacctgatggtttgtctggccgtgtggatgagctactcaggtcgtagcctgatggacaaagcgttcatcatggtactgcccgtcgccatgtttgtcgccagcggttttgagcacagtatcgcaaacatgtttatgattcctatgggtattgtaatacgcgatttcgctacaccggagttttggaccgcggttggttcgtctccggaaagtttttctcacctgaccgtgatgagcttcatcactgataacctgattccggtcacgatcggtaatattatcggcggcggtttgttggtcgggttgacatactgggtcatttacctgcgtggtaacgagcatcattaatctgttgatgtccattacacgcagtaaataaaaaatccacttaagaaggtaggtgttacatgtccgagcttaatgaaaagttagccacagcctgggaaggttttaccaaaggtgactggcagaatgaagtaaacgtccgtgacttcattcagaaaaactacactccgtatgagggtgacgagtccttcctggctggcgctactgacgcgaccaccaagctgtgggacagcgtaatggaaggcgttaaacaggaaaaccgcactcacgcgcctgttgactttgacacctccgttgcttccaccatcacttctcacgacgctggctacatcaacaaagcgcttgagaaaattgttggtctgcagactgaagctccgctgaaacgtgcgattatcccgtttggcggcatcaaaatggttgaaggttcctgcaaagcgtacaatcgcgagctggacccaatgatcaaaaaaatcttcaccgaataccgtaagacccacaaccagggcgtattcgacgtttatactccggacatcctgcgttgccgtaagtccggcgtgctgaccggtctgccggatgcgtatggccgtggccgtatcatcggtgactaccgtcgcgtagcgctgtacggtatcgactacctgatgaaagacaaattcgcgcagtttacgtctctgcaatccgatctggaaaacggcgtaaatctggaagcgactatccgtctgcgtgaagaaatcgctgaacagcaccgcgctctgggtcagatcaaagaaatggcagctaaatacggctgcgatatctctggcccggcgactaacgctcaggaagcaatccagtggacttacttcggttacttggctgcggttaaatctcagaacggcgcagcaatgtccttcggtcgtgtatccaccttcctggatgcgtacatcgaacgtgacctgaaagcaggcaaaatcaccgagcaagacgcacaggaaatgattgaccacctggtcatgaaactgcgtatggttcgcttcctgcgtactccggaatatgatgaactgttctccggcgacccgatttgggcaaccgaatctatcggcggtatgggcgttgatggccgtactctggtcaccaaaaacagcttccgtttcctgaacaccctgtacaccatggggccgtctccggagccgaacatcaccgttctgtggtctgaaaaactgccgctgaacttcaagaagttcgccgctaaagtctccatcgacacctcttctctgcagtacgagaacgatgacctgatgcgtccggacttcaacaacgatgactacgctatcgcatgctgtgtaagcccgatgatcgttggtaaacaaatgcagttcttcggcgcgcgtgcaaacctggcgaaaaccatgctgtacgcaatcaacggcggcgttgatgaaaaactgaaaatgcaggttggtccgaaatccgaaccgatcaaaggcgatgttctgaacttcgacgaagtgatggatcgcatggatcacttcatggactggctggctaaacagtatgtcaccgcactgaacgttatccactacatgcacgacaagtacagctacgaagcctctctgatggcgctgcacgaccgtgacgttatccgcaccatggcgtgtggtatcgcaggtctgtccgttgcggctgactccctgtctgccatcaaatatgcgaaagttaaaccgattcgtgacgaagatggtctggctatcgacttcgaaatcgaaggcgaatacccgcagtttggtaacaacgacgctcgtgtagatgacatggcggttgacctggtagaacgtttcatgaagaaaattcagaaactgaccacctaccgtggcgctatcccgacgcagtctgttctgaccatcacttctaacgttgtgtatggtaagaaaaccggtaacaccccggatggtcgtcgcgctggcgcgccgttcggaccaggtgctaacccgatgcacggtcgtgaccagaaaggcgctgtcgcttctctgacctccgttgctaaactgccgtttgcttacgcgaaagatggtatttcttataccttctctatcgttccgaacgcactgggtaaagacgacgaagttcgtaagactaacctggcaggtctgatggatggttacttccaccacgaagcgtccatcgaaggcggtcagcacctgaacgtcaacgtcatgaaccgtgaaatgctgctggacgcgatggaacatccggaaaaatatccgcagctgaccatccgtgtatctggttacgcagtacgttttaactccctgacgaaagaacagcagcaggacgttattactcgtaccttcacgcagaccatgtaatgggtttgactgaaattacgccataaaaagcgtacaaaaaaggctccatatcagtggggcctttttaatgactttttatataagcatattgcgacaactagaattttcacttataaataaagtgttatcatgtgatctatatattcttcttagaatagaatcaatttctcttttattattttgatactcatcataatccttatttaatacatcagaaaacagcatggtgttagtttctattaaatcagataacaatgacggtttatatgcgtgtagcagatagataagtgttggatgaaccatatcaaacaggacttctccctctaattcccagtaacctattttacaaaattgggtagtaatattaaaagaccccatttgaagacagcgtagtttattcatctcctcttcagtaagcgtaccattccattcaacacattccatttttcgatcttctccagatcgcataaaattataaacttcatccttaatgtcatcatcctcattaactgcatctttaagtttattagcaaagccttctaataattctggatagcgagcaattttttctccatacttaatacatactttaaaaaacaactctacttcatcgtcttccatcactctaaaaatacagttttctgaaacgttgaggagacgatgcaaattacatttatcaataacctggccatcaatctcaaataaaacttttgtctgattcatatcaaaacgcataacaaagcgctcttgttgagatggattagcatattgttttaattgtgtaaaggcatgtatcttctccatgccggttatatcaacattaagttcagcttgattttcacgttcacatccatggatgagtgtatataatacctccagcacctcttttttttgtgtgttctgaagcagtccttaaatctatcccatacccccatgtatagcgcttcttctttattaggactcatcaaacgggttagccgtgaagtattaacttcatagttatgacgattaccaaaacttaacgtaactggcataataactcctttgattatttaccgcgaaagcaaaatccaatccgttgctctcattttttgattaaaaccacactctatttaagagattgaatcagtccgggtttagaaatgacatcagatttacacctgattgcgcgttgaatgcaacgccaggcactggacaggcgtaacgttctttggacacatctgaattatgttgagaattatttttgttctgaccacaaaaacggcatcaaccatttgaaaaaagaggcggttcataaacagcaaaaccaggacgctatggatgatacacttacagtatgtattgcggttcgggcgttacgagctgatgaatgagccacaatttctggcggtgcaagctatgcagcatagatttgccgtatattttatactgaatagaggtaaaatagctccattgcagcacattctggaacagccacacattctgtagtccaaaatttacgctcgcagtaccgcttttttacaggatgcaacccccttactagggtgctcaacatgcccggaatgtgtccataaaccccatgttatttagagctagccgaagcgatatgagtaacttaaccgattgtattacaaatgaaagtgttgcagtaactgctgataaaaagccggttattggtcgcattcactcctttgagtcctgtggcaccgttgatggcccaggcatccgctttattacctttttccagggctgcctgatgcgctgcctgtattgccataaccgcgacacatgggatacgcatggcggtaaagaaatcaccgttgaagacttaatgaaagaggtggtgacctatcggcattttatgaatgcttctggcggcggcgtgacggcatccggcggcgaggccattttgcaggcagaatttgtacgcgactggtttcgcgcctgtaaaaaagaaggtatccacacctgtctcgacaccaacggctttgtgcgccgttatgacccggtgattgatgaactgttggacgttaccgatctggtgatgctcgatctcaagcagatgaatgatgagatccaccagaatctggtcggtgtatccaatcaccggacgctggaattcgcgcagtatttatcaaagaaaaatgtgaaggtctggatccgttacgttgtcgttcccggctggtctgacgacgatgattccgcgcatcgcctgggtgagtttacccgcgatatgggtaatgtcgaaaaaatcgaactgctgccctatcatgagctgggcaaacataaatgggtggcaatgggcgaagaatataaactggatggcgtgaagccgcctaaaaaagagaccatggaacgtgtaaagggtattcttgagcagtatggtcataaagtgatgtattaatcgcctgctatcttatccgcttttaaacggctacccatgacggtagccgttttgctgtctgggtaacgctcttaccgctaaaatacccgaccccgccgtcagacaggcctggttaacaatattgcgcttaccaggtattaaatacagagtcgcttatctgctgctgggttgaaggtctgacaactattgctgccccggcgcctgttaataccgtggtctccgcctggaacccaggcacctgtaaccttaaaaggcgctcgcctgacaggagcgccgtggaaaagagcgtcgttatgtgtttctacgcgccagcagtgggaaaattaatcccaacccgaccaggacaaaaggtgtcacgatgttcaacgtcagctggaatgcccactccggcgtgaacgcctccattttggggaaaataccggtaaggcaggcaaacgcggtgaaggcaaaacaccatattcccacagttaacgccaacgcccggttgcgaataaacacatattcgggtttgtacttttgcgccagtcgaatgacggcaataaaggcgacaaatacccacagatagcgcagcggcataacgactgaattgagattaagcagccatttgtacaggttgttcatatcgccgatgccaagcgttggcaacataatcaagatagcgaccaacactaatgtcagcaaataaccgttaactggtgtacctgaagcgttagtacgacataagcgctgcgggatatatttactgtctgcatcacccagtaagactttcagtggcgcatcaatagaaaacaccagcgcggcgatttgccccagagtattggcaatggcataaatcaccattaatgaattacccatatggtaatactcacccaatttctggaatgcataatattgcccattggtcattaaatcgtcaggtatatgccgggaatcaaacatcattcccatcgccaacgaaccgaggatagcgcagaccgcaaccatgacggctaaaaagagcatccccttcggaaattcttttcctggattccgcgtctggttgacataaggcgagatcttctctgccccaccaaccgcaaagaccaacatagagatggtggtgatataggtaaaatcgatatgaggaataaatgactgccaggtgatgttagcggtcgcaatttcaacgtttgtaattgctggcgcggtcactgccatcacaacatataaaattgacatgataaacatggcaatcccagccacagacccaacaacctttagcgatttcatcccccgggaagcaacccacataaagaaaacaaacaatgccagcgtcagcccctgcaaggcaacgacggtatattcttttatcaacgagccgtcgccttttaaagcccatcccaatgcaatgagtatcgcctgcggcttttgcgccaggtagggaatatgcacgacccaataagtccatgccgcaaggtaagccaaccccggccccatcgtatgcttaatccaggtactgacgcccccttttccctctttgaaggttgagcccagttgccccacgattaaggcataaggaataaaatagagcgcaaaaataaacacccaggagaagacaaccactaacccctggttagcatagttattgacaacattgccgaatccccaaacggtaataaacgacatcagggcgatgttgtaccatcgcaactgtttttcctgcacattcggcataacgcgatccttcgtgaacacaatgctattactataaatgaagcgggggattatgcgcggtaaagacgaagagagaaaatagaggagcgcaaaattataaccttcggcacattttatttttcagtaaagcaagaaaattatgcaggtcaattattttacgtaaaacataaacaaagagtatgcaagactcacgtcctgcatacgattcagagaacagttagatgtgggcgacaggattaggcgtctggccgacgttacgtaacagcatcagcagataaataaacgatacgctggcgatcataataaacagcagattatctgaataattctgcattaacatcgcagcaaaagacggccccaacaggctccctaccgtataacttaacaacagcgcctggttcattgccacaagctggtggtgttcgactttttcacaggcccaggccattgcaacgggataaagcgtaaaacccgccgcccccagaataaacagagctggcgccatcgccgcctgggttaacatggcaatactgccgagtatgacaacgaatacctgtacgcgtaataccagcaagcgaccaaatttgtccgccagacgtcccattggccattgccccaaaataccggcgctcaccagcaccgccatccagaaaccgatgctggcgttagccatcccctgatgcttcagatataacggcatcaggccatataatgaaccaagaacaatgccggaaataatacaaccattcacgccaagacgcgcctggcgtagcttcagcatggcgctaatagaagaggaatgacgtgcctgcgtttgctgatttacaattcgggtaaagagtagcggcagaattcccgccagaatcattccggtcacccagggaaggacgtgcagcaattcaccagatactttactgaccaataattgtccaaggaaggtccccatgtaatagaccatcatataggcagccagcaggcgtccgcgattatgcgaggttccgctgcacatcaacgcgctttcgacaaccacccaaatcatggcgcagccgataccggcaataaaacgccagctcatccagctccagaaccccaccatcacccccaacccgacacaacccgcggcgaagatcagcgaggcaagataatagctacggttaaacccaatgcgtttaattaaatacccggtaaataacgtcccgaccagattgccggtaaaataagacgagctgaccatccccacctgccaggtcggaaggtttgcctgagcaagccacagcggcacaagcgtattcagtaccgcaatggccagggtcaacaaaagtagcccgcacagcaaaagcatgacgggacgggtatagatggacatgaataaaaaccgtgaggaagttcaaatttcatgcgcatcatgccatcgccaaaaacattgtcaatcggctccgcatgggcgatccgcaagttttgagactatcgattcgatttacttattctgcacgtgaatatattgaaaggctaaaaattcatccccttgtttttattgatctaacccgcaaaatcggcgttttgttcagtcgaaaaatttcatggttcctttagcttcgttttcttctctatggatttatatgcgccttctccgccccggttatattccttagattgacggcggctaaaggcgtattcggcctgcacgttctgcaggccgaatgcgcgtcaacgcgttagctggctaccgccatgcccacggtcatatgcagcccatagaatacgccgcggccaatcaattcccccgccagcatcagaatgaaggcgacagagagtaacggtaccgcaggttgatacccttttaactgtggcacaatccagcagcacaacgccgccgcaagcagcaccatacgccaggccatcagcgaaccataatccggcaccagagcagacgcctgctgaatggaactgtgaatcgtcgccagttccgcgccctgcatggccaccataatggcaataaccaccagcgccagcaccgaaaccgcaggcaacagacgcatcgcccaaccgttcacgcccgcgatgcgcagcagcagataacccagtagcgggccacccataaagagcgtcaggaagaagcccagcggcgtccagacgctataccaggtcggtactgtatcgatgctgttatagacgcgtaccatcatccagacgaagacgacgcccagtaccatcgtgataatcagccagagtgtgcgcagtgccggcggcagctttttcagtaccgccagcagccagccgatcccgccgaccgcaaaaaacaccgagccgctggcaatttcattgctcagtgcggaagcacccacgcggttaagcgagttaaacgcgcgcatcggcgagcccagatgcagcatcgaggcgataaagccaatccccatcagcacccacagaccaaacatacaggcgatcacccgctgctgcgtttccgcgcgcaggtcgcccttcatcagcgccagagccagaacaataaaaccaccggccacgcactgaccaaagaccgtgaagatcatcaacggccattcatgccatccacttcccatcttatacctccttcggattggccagataaccggtggtgtccccggtcgggcggctgttggcgttgggtttaatcacaatattcggcttcgtgaaatgcgcgcgcggcaacggcgcgacggcagccagctcaccgtgttttttgcgcagttcgtctatcgggccgaaatccagcgcccgcagcggacaggattcgacgcagatcggtttcttaccttccgccacccggtcataacagccatcgcacttggtcatatgacctttggccgcgttgtactgcggcgcgccgtacgggcaggccatgtggcagtagcggcaaccgatacagacctcttcgttcaccaccacaaaaccgtcatcgcgcttgtgcatcgcgccgctcgggcagactttggtgcaggccgggtcttcgcagtggttacaggagatggagagatagtaggcaaagacgttctggtgccagacgccgttatcctcctgccagtcgccacctgcatactcataaatgcggcggaagctgacatccggggtcaaatctttgtagtccttgcaggccagttcgcaggttttgcaaccggtgcaacggctggaatcaataaaaaatccatactgggttgtcatcggttactccttacgccttttcaacctgaacgaggttcgtatgtgacgggttccccttcgccagcggagaaggacgttgactggtcagtacgttaatacatccgccctgatccacgcgttttgcatccgggtcataccatgcgccttctcccagagcgaccacgcccggcatcatgcgcggcgtcactttagcctcgatatgaacttcgccgcgatcgttgaagatgcggactttatcgccattgttgataccgcgtttctgcgcatccattgggttaatccacatttcctggcgacaggcggctttcagtacgtctacgttgccataagtggaatgcacacgcgctttatagtggaaacccgtcaactgcagcgggaatttatccgttagcggatcgttatagttttcaaaacctagcgtgtagatcggtaatggatcgatcacgtcgccttccggcagctcccaggtggcggcgatatccgccaacgcctgtgaatagatttcaatcttgcccgatggcgttgtaagtggattcgcttgcggatcttcgcggaagtctttataggcgacatggtggccttcggggtcgcgctgtttgaagatgccttgcttacggaactcctcaaaggtgggcagattcggaatggatttacgcgactgttcgtacagatgacgcatccactcttcttgcgtccggccttcggtaaactgttgttccacgccaagacgtttcgccagttcgctggtcatctcataaatcgtcttacactcgaagcgcggtttaatcgcctggtcagtgaagataacgtaagacatgttcccgcaggaggcatccagcgcaaagtccatctgctcagaagcagtgcaatcaggcaacagaatatcggcgtattttgccgacgaggtcatatgacagtcgataacgacgatcatttcacatttactgtcatcctgcaggatttcgtgggtgcggttaatctcagagtgctggttaatcaaacagttgccagcatagttccagatcattttgatcggcacgtccagcttatctttcccccgcacgccatcacgcagcgctgtcatttccgggccgcgttcaatggcatcggtccacataaacatggagatgctggtttcaaccggattttccaacgtgggcatacgttcaaatggcagggcataagacccttcgcgcgcgccgctgttaccgccgttaatcccaacattacccgtcaggatcgccagcatcgagatggcgcgcgtggcgatttctccattagcatgacgttgtggcccccacccctggcaaatataggcgggtttagcgctgccgatttctcgcgccagtttaataatgcgatctgccggaataccggtaatttgcgccgcccactccggcgtctttgcgataccgtctttacccaagcccagaatataggctttgtagtgaccgtttttcggcgcgctggcaggcaaggttttttcgtcataaccgacgcaatatttatccaggaacggctgatcgaccatgttctcggtgattaagacatatgccagaccattgaccagcgccgcatcggtacctggacgaatcggaatccactcatcttcgcgaccggcgccggtgtcggtgtaacgaggatcgataatgatcatccgcgcgtttgatttctgccgcgcctgttcaagataatacgttccaccgcccccgctcatgcgggtttcgccagggttattaccaaacaacaccaccagcttactgttttcaatgtcggatggactattgccatccgcccagccgccataggtgtaattcagacccgctgcgatttgcgcggaagagtaatcaccgtagtgattaagataaccgccgcagcagttcatcagacgagcgaccagcgtttttcccggcggccatgaacgtgtcaaagtgccgcccagcgttcccgtgccatagttcagataaatggactcgttgccatactctttgataagacgctgcatattggtggcaatgatatcgtaggcttcgtcccagctaatacgctcaaatttaccttcgccgcgcgcgccgacgcgcttcatcggatacttgagacgatccgggttatagacgcgacgacgcatagaacgaccgcgcaggcaggcgcgaacctggtgcaggccatcgtaatcatcgtttccggtattatccgtttctacatatttgatttcgccatccacaacatgcatacgtagcggacaacggctgccacagtttaccgtacaggcgctccagacgactttctcgtcggttttcgtcgggcttatcgcctctgcggcgttagcgatgcgggtaaatggcagggtaaatgcgctactggccatcgccaggccgcctatcgcggtggttttgactaaaccacgacggctcacctcggctgccagcacggcatcagggatcttagttttcataagggctcactctgctgctcacaataaaaaagcaataaaacgatgtatagaattttatatagcgataacgtcgctataaagtctgatatatatcgaaaaagtagaaaaatagcgttaaaaactgaccttcattcgaaatcagtattacccctaatagggtagggattattgtccggtatcaaactggcataaaaaaagcgcccgcaggcgctttttagaagaggagaaagcgaggattagccgatatattccagtccgttcatgtacggacgtaatacttccggcacttcaatacgaccatcagcctgctgatagttttccatcacagccaccagggtacgacctaccgccagaccagaaccattcagggtatggaccagacgggtctttttgtcggacttgctgcgacagcgtgcctgcatacgacgcgcctggaagtcccagacgttagagcaggaagagatctcgcggtaggtattctgcgccggaacccagacttcgaggtcataagttttgcaggcgccgaagcccatatcgccagtgcacagaatgattttacggtacggcagtcccagtagctggagcactttttccgcgtggccggtcatctcttccaacgcagccatagaatcttccgggcgaacgatctgcaccatctcaactttgtcaaactgatgcatacgaatcaggccgcgggtatcacgaccataagaacctgcttcagaacggaaacaaggcgtatgcgccgtcattttaatcggcagctgatcttcgtcgatgatttcatcgcgtaccagattggtcagcggaacctccgccgtcgggatcaaagcatagttactgctgtctgcttcttcttccagcggacgggtatggaacaagtcgcctgcgaatttcggcagttgaccggtgccatacagcgtgtcgtggttaaccagatacggcacgtagttttcgctatagccgtgctgttccgtatgcagatccaacatgaactgcgacaatgcgcgatgcatacgcgcaatctgtcctttcatcaccacaaagcgggagccggtcagcttaaccgcagcggcaaagtcgaggccggagtgcatttcccctaaggtgacgtgatcgcggatttcaaaatcaaactcacgcggggtaccccagcggctgacttcaacgttgtcgttttcatctttacctaccggcacttcatccgcaggcaggtttgggatggtcagcgcgatatcgcggatctccgccagcaaggtatccagctcggctttcgccgcatccaactcttcgcccagtttattcacttccaggcgtaaaggctcgatatcttccccgcgcgctttcgcctggccgatggatttcgatcgagaattacgctccgcctgcaggttttccgtgttgacctgcaaaactttacgacgctcttcaagagcgcgcagcttatctacatccagcttaaagccccggcgtgccagtttttcagcgactgcgtctggctcattacgcagcagattgggatcgagcatgcttatcctgtgcttatcgaataataaaaggaaacgcgatcaattgatgatcgcctctgattgtattgatgaacgtaaaccccgtttacgtaatagcgacgttttcgccttacctgaccgacgacagcaacaacgcatccattgcgctatacccgcggacctcataagcaacgtgctatcaggcataacgaggttcatcatcaacgccatgatacctggagcatcatatttagagataaccttaccgcaacgtttacactagcggtagcgttttgtggggctattttgatcctgttcagccagccaggcgagcttttcgccaatcttaccttccagaccacgatttgtcggatgataatagcgcgtttgcgcgatttccggcgggaagtacacttcacccgcagcataggcattgggctcatcgtgggcatagcggtattcctggccatagcccatctctttcatcagtttggttggcgcattacgcagatggacaggaacgtcataatcaggacgttcgcgcgcgtcggccagcgcagccttaaaggcggtatagacggcgttgctcttcggcgcgcaggcgagataaacgatagcctgcgcgatcgccctttcgccttcagccgggccgacgcgggtgaaacaatcccacgcggcaatggcgacctgcatcgcgcgaggatcggcattacccacatcttccgaggcaatcgccaggcagcgacgcgccacgtacagcggatcgcctcccgcggtaatgatacgggcataccaatagagggcggcatccggcgcgctgccgcgcactgatttatgtaaggcggaaataagatcgtagaagcgatcgcctttgttatcaaaacgcgcgctgcgctcgccggcgatctcggtcaacaaggcgggcaataaaacgcgtttgccgctgtcatccgcctccgccatatcagccatcatttccagcgtatttaaggcgcgccgcgcgtcgccattgaccagctcagcaatcgctcgccgtgtctcatccggtaacacgatatcctgatcgccgtaaccacgcgttttgtcctgcatcgcctggtccagtacttgctcaatatcgtcagtagtcaacgatttcagcagatagactcgcgctcgcgacaatagcgccgagttcagctcaaaagagggattttccgtggtcgcgccgataaaggtgatagtgccatcttcgatatgcggtaaaaaggcgtcctgctggcttttgttaaagcgatgcacttcatcgacaaacaggatggtacggcgaccggcattacgattctggcgggcgcgctcgatagcttcgcgaatctcttttaccccagaagtgacggcggaaatacgctcgacatcggcgctggcgtagcgggcgatcacttcagcgagcgtggttttccccgtccctggcggcccccataaaatcatggagtgcagatgcccggcctcaatagcgcgaggcaacggcttacctgcggccagcaaatgctgctggccgatatactgtgctaaattttccggccgcattcgcgcggccagcggttgaaacgtattatcagaaaaatcgagcgacagattgctcactcatcgcctctacttacgttggtcgtctatcgttaccccttgcggcggagtaaacgtaaattttgacggttcaacagcgccgttttgctgggattttagctgataggcgctacgctgatcgtcttgttctacggcgctaaactggtggatagtcccgtcgcgtcccacattgatggtgaactgtttcagattgccgttgctggctttcggcgtcagcacaaaattatcgccatcctgcttaatattatactgctgccagtcgctggcctggttgcgggcaatcagcataaacggtgtatttccggtggcatctttcaaccacgtggcggtagcctgttctacaaacgggttatagaaccataacgttttgccgtcagaaaccagaatactctcgtcaggttgcgtcatatgccagttgaatagatttggccgcttaacccataaatcaccctgtccctcctgcaccgcggcaccgctgccatcggtgactttttgagtaaaggtggcatgaaagctgctcactttatccagacggcttttcagagagctggcggcgtcagcccatacgctgctggctacaacgcttgaaagtaatgcacaggcgattgccatttttttcatcattattcctcaagtttcgacactcccgaccaggagctccttttgctttctattccaggccaaaaatcagcatgaggaaagaagaaaatactgaattttgttgccggatggcagcctctgaacagcgccatccggtttacaggtttactcaaaaggcggcggagccaacacttcgcgattaccgttatgcccctgagcgctgacaataccctgcgcttccatctgttcgataatacgcgccgcacggttatagccgatacggaactgacgctgaacgccggaaatggacgcttttcgcttctgagtgacgaaattaacggcctgatcgaatagcgcatctaattcttcgccgccgtcaaaaccgccaccgccaccttcgctttcgctgtcggaggtaatgccatccacatattgcggacgaccgcgcgctttccagtcctgcaccaccgcatggacttcctggtcacgcacaaacgccccatggacacgtaccggcatggtggagtttggtccggaatagagcatgtcccccattcccaataacgactcagcgccaccctgatcaagaatggtgcgggagtcgatcttgctggatactgtaaaagcgatacgggttggaatgttggctttaattaaaccagtaatcacatcgaccgacggacgctgcgtcgccagtaccaggtgaatccccgcagcgcgcgctttctgcgccaaacgcgcgatcagctcttcaacttttttaccgacggtcatcatcaggtcggcaaattcatcaaccagtaccacgatatacggcagtttttccagaaccggatgctgaacatccatactgtcgcccggcttccagtacgggtccggaatcggacgtcccatgcgggccgcttcggcgattttctcgttataaccagccagattacgcacgccgagcgcggacatcagcttatagcgacgctccatctcattgacgctccagcgtaacgcgttagctgcatctttcatatcggtaacaacttccgtcagcagatgcggtataccttcatagaccgagagttctaacattttcgggtcgatcatgataaagcgaacgtcttccggctgcgctttatacagcatactgaggatcatggcgttaaccccgaccgacttaccggaaccggtcgtaccggccaccagcaggtgaggcattttcgccagatccgccactaccggatcgcccgcgatatccttacctaacaccacggtaagcggcgacggattctcgcggaatttggcgttatccaacacttcgcgcagataaacggtttgccgtttcttgttcggcaattccaaccctacgtaaggtttgcctggaatgacttccacaacgcgtacggctaccgttgacaaggagcgcgccagatcccgggaaaggttggagatacgcgctgctttaacgcccggggccagattcagttcaaagcgagtaatgaccgggcctggcgaatagttcaccacatcagctttaatgcggaaatccgccagacgcgcttcaaccagacgcgccatttgttccagcgcaaaggtatctaccggttcaacttcgctcggcggcggcgtcagaagatctaatgaaggcagcggcgtcgtcggacgctgcaatggacgactgtcgccgttacgcatcaacagcgggtggatcagactgtcttgcggcgctgtcggttgctgcggctgctggtactgcggctgaggcgctaccggctgttgcggctgctgatactgtggctgcggcgctaccggctgttgcggttgctgatactgcggctgcggcgctaccggctgttgcggctgctgatactgcggctgcggcgctaccggctgctgcggctgctgatactgcggctgaggcgctaccggctgttgcggctgctgatactgtggctgcgacgctaccggctgctgcggctgctgatactgtggctgcggcgctaccggctgctgatactgcggctgcggcgctacaggttgctgaacaggcgttgactcgggcatgacacccggcgtgaacagcggttcgtgcggaccttcatcaaccaatactttcattggcgagaaatccagatcgtccagtgagaacggctgcgcgccagcgggttgctcgccggaatagcgctgctgttgcgaagcggcaaactggcgggctaattcagcttccgcagcggtatcgtcatcttctgcctgttgagtatcatgctgatacgtctcaccataacgatgctgctgcgactgcgcaaactgacgggctaactcgtcctgatgcattgcatctatttcttcatcggttagctgcgcgcccgtctcgtactgattgcgctccgcctcgcgggctttttcttcagcaatcctctgtgacggcagcttaataccgtacgatgccagttcccgtcgggtcggcacgcgaacgcggttcggacgcggcagttgcggaccaatcccctctttcacctgcggacgcggcgcgccgccggtagccagactaaatgcaggcgcagcggccgcggcgcctgctgccagggcgccactcttaatacctgtgtcaagcgacgcggcggcggctaccgcttccactggcggtatggacggcgcgacagataccgtaggtttgaccggcacgttctcttttaccggctccggaatcggttgataccatgccgccagttgttcgcgctcacgggcgcgtttctcttccacctcttcaaaatagtaaagcggagggcgagcgggcctggtctcttctatgccaggttcaggctcggtggcaaccggctgttcgataaccggcggcggcatgtgggaaggttcagccgctatcggctccggctgccagtgttgttcggcatccggcgcctgccattgcggctgtgtttcctgcggcgcaagagagtcatattctgctgcggtcgctggcgtcgcggcgtattgcggcgcggaagcgacaggcacaggttgctgccacggcgcactttgcgcctcctgcggttgagcatattgcggatgcggctgatacccctccggcgcaggcgcgataaccggttcgccggtttgcggccccggtacgggctgccactccacggtcggttgcgcgacaaccggctcagcccccggcatgggcggcgtttgcattatgggatcggcggacgctgcccacgtctgggtgacggcagttgcggccgcagcggcggcgaccggttcggtgacagaatggccgtttaacagcggatcatattcatcatattccgactgcgtcgcacggttgcccgaaaacagaacgtcgtcgggatcggcagcgacgccgcgcgcgctatactgaatgtcctcgtcatcatccatccgtttgccggaaaagagcgcggcatcggtctgacggccccgtggattgctgaatttttcagccagtcgcttacgacgcgccaacgcgccgcgcaaaatacgcgcccggcgagattcacgctgcacgccatcggtttcttcatcgtattcgtcatcatactcttcgtcgtcaacccacgtatcatcacgccgggtacggttgctggcgaaggtcagtatattaagcagccagccgcctaatttttcggcgatactaacccaggaccagccggtaaagagcgtcagcccggcagcccaaatacagagaagcattatcgttccgccgctactatgcaacaacggctgcagcgtggtgcttaacaggctgccaattacgccgccggaggcgaaataccagatatcgtcggcattaatggccgccagaccgcaggaagtgagaatcagcgccagcacgccaataaggcgtagcgacacagcaaaatagtcgatgtaatcatccgtagactgatgacgccacgcaaaccaacacccgccgacaataatgacagggatagtgtaggccattacgccaaaaataaagaacagtgtatcggccagccacgcgcccggcgcgccgcctaaattatggatgggttcatgccaggcggtttgcgaccaactggggtccgaagggttaaagctcaacaaggccgccatcaaccagacggcaaaaagggcaataagtatcaacaacgcttccagaagtcggcgcccgctgcttaacttcgtcaatgtgacgtctttgtcttcagtatattcctggctcaaaaaaggctctccaggttccaggcttttcccgcccgatgctaaaacggacaacagcaccgggttgccccggcactgttgctgtatggattaacaggagtgtaatcaaactacggcgattttgcacctgttccgtgttagcgtgtcttaataaccagacgattactctgttttacctcttccatcactacgtaagttcgggtgtcgttcacacctggcaagcgcagcaacgtctctcccaatagttttcgatacgctgacatatccggtacacgggttttcaacaggtagtcgaaatcgccggaaaccaaatgacactcctgaatctcttcaagctttttcacggcggcattaaactgttcaaacacatccggcgcgccgcgatttaaggtaatctcaacgaataccagaagtgacgcatccagataatgcgggttcaacagcgccgtatagccctggataaacccctgtcgctccagccgacgcacacgctcaaggcaaggtgtcggcgaaagtcctactcgtttagaaagctcgacgttggaaatacgcccatccttttgcagttcattaagaatgttacgatcgatacggtcgagatctttgccagggcgcttcttgctatctaccattattattgtctctctgtattccttccctactcctgcctgactctactcacatcactgttcagagtcgctgcccatcacaatagaccgaaacccagagggattaacggcgtgcaatgcctggtctatggtgagaagaccgttgcctcgcggcagctatcgacatcacgaatggcgtctgtccacgccatgcgtagatttcactagcccggtaaacatggtatttacatgcatgattatgcagcacatacataacacagtttttttcttcctcgaatgttttcgcaaaacagcaggtgattgtcaaagcaaaacatcgatttttagtacaacatgccagttattcattagagagggcggtaaactgtcatttcgtcaccttataagttaccgattttaattaaagtttgtgatgataacgtcgctgccgcggtcgttcatcggttcatgctattacacatattgttaacaaaatcgttatgctctttttttacgtctgtaaattctctacaattctgctcattgtctgccaacaactatggggatctcatgggcacgaccaaacacagtaagctgcttattctgggctcaggaccggcgggatataccgcggcggtgtatgccgcgcgcgcaaatttacagccagtacttattaccggtatggaaaaaggcggtcaactgactaccacgacggaagtggaaaactggcccggcgatccaaacgatttgaccggcccgctgctgatggaacgcatgcatgaacatgcggcaaaatttgaaaccgagataatttttgatcacatcaacaacgtggatctgcaaaatcgtccgttccgtctgacaggtgacagcgcagagtacacttgtgatgcgttgatcattgcgaccggcgcttccgcgcgctatctggggctgccatcggaagaagcctttaaagggcgcggcgtttccgcctgcgcaacctgcgacggtttcttctaccgcaatcagaaagtggcggtgatcggcggcggcaacaccgcagttgaagaagcgctttatctgtccaacatcgcttcggaagtgcaccttatccatcgccgtgacggtttccgcgctgaaaaaatcctcattaagcgcctgatggataaagtcgaaaatggcaatatcatcctgcacaccaaccggacgctggaagaagtgaccggcgatcagatgggcgttactggtctgcgtcttcgcgacacgcagcagagcgataatatcgagacgctggacatcgccggacttttcgtagccatcggtcatagcccaaacacggcactcttcgaaggccagcttgagctggaaaatggttatatcaaagttcagtccggcacccatggcaacgccacacaaaccagcatccctggcgtattcgcggcgggtgacgttatggatcatatttaccgtcaggcgatcacctctgcaggtacgggctgtatggcggcgctggatgccgaacgctatctcgatggtctggccgacgcgagcaaatagtttttacaaatcagtaacaaaagtaaaaaaggcgactataagtcgcctttatttttgcgtcgttgtaacattgccctgcctgaaattccaataactcacctgctaagcgtgcaatgaataaaacccgtcaaaaagagctgacccgctggttaaaacagcaaagcgtaatctcccaacggtggttgaatatttcccgcctgttggggttcatgagtggcgtattaattgtcgctcaggcctggatcatggcgcgtatcctgcaacatatgatcatggagaacattccacgggaagcgctgttgctcccttttatcctgctgatactgatctttgtcctccgcgcctgggtggtgtggttgcgcgagcgcgtcggttttcatgccggacagcatattcgctttgagatccgccgtcaggtgttggatcgtctgcagcaagccggcccagcctggattcagggcaagcccgccggtagctgggcgacgctggtgttggagcagattgacgatatgcatgactattatgcgcgctatctgccgcaaatggcgcttgccgtttgcgtaccgctcttaatcgtggcggcgattttcccgtcaaactgggcggcggcgctgattctgctgggcactgccccgctcattcccctatttatggcgatggtggggatgggcgcggctgacgccaaccgccgcaatttcctggcgcttgcccggctaagcggccattttcttgaccgtctgcgcgggatggaaacgctgcgaattttcggtcgtggagaagcggaaaccgagagcattcgcgcagcatcgcaggattttcgtcagcgcacgatggaagtactgcgcctcgcctttttatcttccggcgtgctggaatttttcacctcgctttctattgcgctggtcgccgtttattttggcttctcttacctgggcgagctgaactttggtcattacggtaccggtgtgacgctcgccgccgggttcctcgccttgatcctcgcgccggagtttttccagccattacgcgacctcggcacgttttatcatgctaaggcgcaggcggttggcgcggcggatagtctgaagacatttctggaaacaccccttgcccacccggcgcgcggcgaagttgagctggcggaaaacgaacctgtaaccattgacgcagtcaatcttattatcacctcgccagaaggcaaaacgcttgccgggccgctgaatttctcattagcggcaggagaacgcgccgtcctggtaggacgcagcggttccggtaaaagctctctgttgaatgtattatccggttttctctcctatcagggatctttgcgtattaatggtgtcgaacttcgcgatctctcgccggaatcctggcgccagcatctctcctgggtcggacaaaacccgcaattacctgcggcgacgctacgcgaaaatgtattactggcgcgcccggacgccagcgagcaggaactttatgccgcgcttgacgccgcatgggtaagcgaatttttaccgctgctgccgcagggagtagacaccccgctcggcaatcatgccagcagactttccgtcggccaggcacagcgtgtagcggtcgcccgcgcgctacttaatccctctcaactgctactgctggatgaaccggcggcaagcctggacgctcacagcgagcaacgcgtcatgcaggcattaaaagcggcgtcaaaacgccagaccacattaatggtgacgcatcagttggaagatctcgccgactgggacgctatctgggttatgcaagatggcgcgattgtcgaacaaggcagctatgccgaactcagcgccgccaacggcgcttttgcgacgttattggctcaccgtcaggaggatatttaaatgcgcgcgctactcccttatctgacgctttataaacgccacaaatggatgctaacgctgggaattgcgctggcaatcctgaccctgcttgccagtatcgggctgctgacgctttccggctggttcctgtccgcgtccgctatcgcaggcttcgcgggaatttacagttttaactatatgctcccggcggccggcgtgcgcggcgcggccattacccgtaccgctggtcgttattttgaacgtctggtaagtcatgacgccacgttccgcgtgctgcaacatctgcgtatttataccttcagcaaacttctaccgctctcccccgcgggtctggcgcgatatcagcaaggtgaactgctgaaccgcatcgttgccgacgtcgacacgctggatcatctctatttgcgcgtcatctccccgctggtcggtgcttttgtagtgattatgattgtcaccctggggcttagcgttctcgacgtgacgctggcgatcacgctgggcggcattatgctgttgacgctgtttattatgccgccggtgttttatcgcgccggcaaaaataccagccaaaatctgacgcatctacgcggtcagtatcgccagcagctcacgtcatggttacagggccaggcggaactcaccatttttggcgccagcaaacgctatcgggcgcaaatggaagccaccgaattacaatggcatgaggcccaacgccgacagtctgaactcaccgccttatcgcaggcgttaatgctgctgattggcgcgctggcggtgatgttaatgttgtggatggcctccggcggcgttggcggcaatatgcagcccggcgcgctcatcgcgctgtttgtcttctgcgcgctggcggctttcgaggcgcttgcgcccgttaccggcgcattccaacatctggggcaggttatcgcctctgcgcttcgtatcactgaattaacggagcaaaaaccggaggtgacctttccacaggcagaaactcccgcgccggaaaaggtcacactcaccctgcgggacgtttcgtttcgttatcccgaccagccgattaatgcgctcaatgccctctcattacaggctaatcctggcgagcatgtcgctattctggggcgtaccggctgcggaaaatcaacgctgttgcagctactcacccgcgcctgggacccgcaacaaggcgaaattctgctcaacgatcttccgctatcctcgctgagcgaatccgccttacgccggactatcagcgtggtgccgcagcgtgtccacctgttcagcgccacgctgcgtgataatttattactggcggcgcccaatgccagcgacgaagccctttccgacatgctgcgtcgcgtcggcctcgaaaatctgctcgaagatagtgggcttaatagctggctcggcgaaggcggtcgtctgctatccggcggcgaacttcgtcgcctggccatcgcccgcgcgctgttgcacgatgccccgttgatgctgttggatgagcctactgaggggctggatgcgaccaccgagagcgaaatgctggaattacttgccgatgtgatgcgcgaaaaaaccgtcctgatagtgactcaccgtttgcgcggcctggcccgttttgatcaaatcatcgtaatggacgacgggcgcatcattgagcgaggcactcatgcagaattgttagccggacaagggcgctattatcagtttaaacaacgtctgtaagctattattgaacgatccgacttgcgtactggagtttcgccgtcatgcgtctggttcagctttcccgacattctatcgccttcccttcgccggaaggcgctttacgcgagcctaacggtttactggcactgggcggcgatctcagccctgcccggttgttaatggcctaccagcacgggattttcccgtggttttcgccgggcgacccgattctgtggtggtcgcccgatccgcgcgccgtgctgtggcctgaaaagtttcacctcagtcgcagcatgaagcgctttcacaacgcatccccttaccgcgtgacgctcaattacgctttcgaccgggtcattgatggatgcgccaatcaccgtgacgaaggcacctggataacgcgtggtattgaggaagcctatcgccgattacatgaattgggccacgcgcactccattgaagtgtggcgcgatcgggaactggtcggcgggatgtatggcgtctcgcagggggcgctattttgcggcgaatcgatgtttagccgccaggagaatgcctctaaaaccgcactgctggttttttgcgctgaatttacccgccacggcggtaaacttattgattgtcaggtacttaatagtcataccgcctcgctcggtgccattgaaattccacgtcgtgactacctcgatcacctcgcggccttacgccaacagccgctggcctcccgtttttgggtgccgcggacattatttttgccccggaagtgaatgttttcggcacattttttattggggtgttataattgctgccgcagaattggtttagctcattatcacgcagcccgttgtcaggtaacgcccatcgtttatttcaccgttcccttatatgttgcgcttatgtcgatacatcaggcggtagtatcagggaaaaggtgtataacgcggcgttgtcgtgtgtcgcggaatcatgtgctaaacctggtttgctgtgttttaaacgcacaaatctttacttatcaaaagaagttcggcattatcttgccggttcaaattatggtagtgataccccagaggattagatggccaaagaagacaatattgaaatgcaaggtaccgttctcgaaacgttacctaataccatgttccgcgtagagttagaaaacggtcacgtggttactgcacacatctccggtaaaatgcgtaagaactacatccgcatcctgacgggcgacaaagtgaccgttgagctgaccccgtacgacctgagcaaaggccgcattgtcttccgtagtcgctaattgtctcctcacgccctgaagggcggctggataaaaggtcggtttaaccggccttttttgcgtccattaagtcgatgaatgacgagcaggttactcttccaccatccgcgcatactcttccgtcaaaaaatcgaccaacgcacgtacggaaggtaatagccctcgccgggatgggaacacagcatgaataacctcccgccggggctcccactcttccagcaccgcgaccagttcaccggcggccagttgttctttcaccattaagacaggtaactgcacaagccccacgcccgccatcgccgcctcgcgtagcgccaacatgtctgtagtaatcatacgcggggtaaaatggacttccgcacgcgcgccctgcgggccgtaaagttcccagcggtggatatgcttgccggatgcaagacttagccctggccaatggctcaactccgccggcgcggaagggattcccatccgtgcgatgagatccgggctggcaaacaggcgatgccctctgtcagccaggacgcgcatcaccaggtcgctatcttcaaacgggcgcggcctgacgcgaatcgccacatccaccccctcccctacgacgtccacccgacgattggtcgcttcaagctgtagcgaaacatcaggataacgcgccataaacttcgccagcattgggccgatgtgtacatgcagcagcgtcaccgggcaggttagcttcacgataccgcgaggctctacctgcaatgcggcaatggcatcctgcgccgcctgagcttccaccagcatcgctttacagtgctcatagaatgtttgccccacttcggtaacgttaaactgccgggtggttcgctgaatcaatcgcacgcccagccgttcctccagttgcgcaatacgccggctcagttttgattttggttcatcaagcgcacgccccgccgcggcaaacccaccctcttcgaccacatgcacaaaccacgcaaaatcattgagatccgtttttatcattacattgtcctattaatggaacggtatgagccattttacccactaccgaacattttgtcatgaatataagcttattcacatcaagacaacgccactgaggagaacaccatgaaacagattacaggcgtctataccgcacctcgcccgcactgggttggcgatggatttccggttcgttcactcttttcttatcagtcacatgcgcagcagttgaatccattcctgctgctggattatgccgggccgcacacctttacgccgggtaatgaaaaacgcggcgttggggagcatccacaccgcggtttcgagaccgtgacgattgtttatagtggcgaagtcgagcatcgggactctaccggtcgcggcggcgttatcggcccgggcgacgttcagtggatgagcgcaggcgcaggcattttgcatgaagagttccactccgacgcgtttacccgtcggggcggcgaactggaaatgatgcagttgtgggttaaccttcccatgaaggacaaaatgaccaccccgggttatcaaagcattacccacgatgttatcccgaccgttacgttgccggatgacgccggagtcgtgcgggtcatcgcagggcgttatgaagagacaaaaggcccggcgcacactttctcgccgctcaatgtctgggatatgcgcctgcaacgcaatcgccagcttacattggcacagccggaaggatggagcgccgcgctggtggtactgaaaggcaatatcacggtgaacggcacgacgccggccaacgaagcgcaactggtggtattgagccagcaagggaaaacgctgcaccttgaggccagcagcgacgccagcgtattgctgttatcaggcgagccgctgaatgaaccgattgtgggttacggcccatttgttatgaacacgaaacaagagatcgcagaagcagtccgcgatttcaactccggccgttttggccaaatctgaaaacatgaaggagaacacgatgtcaagtcctgctagttttaatggtttgcgcccggtaattgatgttaacgattccgtgatgcttttaatcgatcatcaaagcggtcttttccagaccgtaggcgatatgccaatgccggaattacgcgctcgcgccgcggcgttggcgaagatggcgacgttagcgaaaatgccggtcattaccacggcatccgtaccgcaaggtccgaacggcccgctgatcccggagatccacgctaatgcgccacatgcacagtacattgcgcgcaaaggtgaaattaacgcctgggataacgaagatttcgttaaggcggtaaaagcgacgggtcgtaagacgctgatcattgccgggacgattaccagcgtgtgcatggcattcccggccattagcgcggtagcagaaggttataaggtatttgccgtgatcgacgcatccggtacctacagtaagatggcgcaggagatcaccctggcgcgtatcgtacaggctggcgtcgtaccgatggatactgccgcagttgcctctgagctgcaaggcacctggaaccgtgaagacgcagccgcgtgggccgacgtttatactcaggtattcccggcctatcaactgctgatagaaagctacagcaaagcgcaggatgtggtgaaaaacaacgaaatgttggattcacagcgctaatttgcctccccgcgccagtttgggcggggattatgtctattgcatgagcaaacgacagtgaatatgtaaattctgcttgaccgttttagcgcaactccctatagtagcgccccgttgccccccaagcggtcaggcagcaatacaatatggtgaggtgtccgagtggctgaaggagcacgcctggaaagtgtgtatacggcaacgtatcgggggttcgaatccccccctcaccgccatatttaagttgagagcctgtacagaagtacgggctttttgcttatatgtatcccccaaaccaaggggggatgagaaccaccgaccggggttcgacaactggcgcagccagttggacagaccgggcgcgcagcgaacgggctgccccgaaggggcgagcaaagcgagtcaatccccccctcaccgccatattcaagaaagagctcgtacgaaagtacgggcttttgtatctaaacttcttgtttttactgtgattttcctgatgaaaggtttgtttttggacctttggttgctacaccaaacttactatagattgtgtaaaacagccctacttccctacctgaaacgctttagaaaagtttgcataagtatctctcggtagtaaaaaagcaccgagttcctctgtctgatgctgctgttgatttgttaaaagatttaccacgattaaaagataacaatcatgtattccctgcccctcgcgctgaaacactttctgatatgtcgttattggctgtattgaaacgaatgggatatatcgacttaacgcaacatggcttccgttctactttccgtgagtgggctggtgaagcaacggattatcaacgtgaggttattgaacatgcgttggcgcaccagttggcagataaggctgaagcagcgtatcagcgtgggacgttatggcctaaacgagtggcgctgatggatgactggacggggtatagcactgccaacagctaagctacctgtacgaaagcattatcgttgataacaacgtagaaagtgtgatgctaatagcattcgctttcgaaaatgtgataaggaataatttcacgatgaactatttcttatatgattattatcatggtttgcaaattacataaaccactcaaggagaggttatgcccggactgataggctactggaagcaacttcccaccaaagatgaatatattaaaaaacacaatatgagcaaaatatcctgctacagttgtggtcacgagaaattcagcgatgttggtttgatacaggtatgggataatcacagaagaattctttgtgctaagtgtaagactactcttttcagagaagaggattagtttttttggcattggtaacagcggcttcagcatcccttttcacgcagcgggtcgggctttttttcgcatttgacccgtcgattaccggatgatggcgcaatttacaagcgccttatccgcctaccgcgagcacaacaccatcaggctaactattagccggcataaaaaaaccgggcgctaaggcccggtttgtacggcagtgaaacgaagattagtgcgcggcttccggcttgtgcttttgcgcactctggaagtcatacgtcaacgcatttttctctttatccagcgcgacggtgacctgtccgccgtcaaccagcgatccaaacagcaactcattggccagtggttttttcaggttatcctggatcacacgtgccattggtcgtgcgcccatcgcccggtcatagcccttttccgccagccagtcgcgcgcttcctgactgacttccagggagacgcctttctgatccaactgagcctgcaactcgacgataaacttatcgacaacctgatgaatcacctcgccagacagatgatcgaaccaaataatgttgtcgagacggttacggaactcaggcgtaaacactttcttgatctcacccatcgcatcggtactgttgtcctgatgaataagaccaatagatttacgttcggtttctcgcacgccggcgttggtggtcatcaccagcaccacgttgcggaaatccgccttgcggccgttgttatcggtcagcgtaccgttatccatcacctgcagcagcaggttaaagacatccgggtgcgctttttcgatctcatccagcaacagcaccgcatgaggatgcttaatcaccgcatccgtcagcagcccgccctggtcgaaaccgacgtatcccggaggcgcgccgatcagacggctcaccgtatgacgctccatatattcggacatatcaaaacgcaacagctcaatacccagcgcttttgaaagctgtaccgtaacttcagttttccctacgccagttgggccggcgaacaagaatgagccgacaggtttatgctcatggcccaggcccgcacgactcatcttaatagcttcggtcagcgcctcaatcgcgttatcctggccgaagaccagcattttcagacgatcgcccaggttcttcagcgtatcgcgatcgctctgcgagacgctcttttcaggaattcgcgcaattcgcgccactacggactcaatatccgccacgttgaccgttttcttacgtttgctcaccggcatcagacgcgcccgagcgcccacttcgtcaatcacgtcaatggctttatccggcagatggcggtcattgatatattttaccgccagctcgaccgccgcacgcaccgctttcgcggtataacgcacgtcgtggtgcgcttcgtacttaggtttcaagccgttgataatttgcaccgtctcttccaccgaaggctcggtaatatcaattttctggaaacggcgcgctaatgcgcggtctttctcaaaaatattgctgaattcctgataggtcgttgagccgatcacccggatcttgccgctggaaagcagcggtttaatcagatttgccgcatccacctgtccacccgacgccgcgccagcgccgataatggtatggatttcatcgataaacaggatgctgttggtatcctgctcaagctgtttcagcaacgccttaaaccgtttttcaaaatcgccgcggtatttggtgcccgccagcagcgaaccgatatccagagagtaaatagtacaatcggccatcacttccggcacatcgccctgcacgatacgccaggccagcccttcggcaatcgccgttttgccgacgccggattcccctaccagcaacgggttatttttacggcgacgacacaagacctggatcgcgcgttcaagttctttttcacgaccaatcagcggatcgatgccgcccacgcgagcaagttggttaagattcgtcgtgaagttttccatacgttcctccccgccagcttgttcgtcgccagctggctgattgccgagatcggaagattggctcggttcgtcttttcgcgtcccgtgagaaataaagttcacgatatccagacggctcacttcatgcttacgcagcagataagccgcctgtgattcctgctcgctaaagatagccaccagcacattcgcgccagtcacttcactacgcccggaagactgaacgtggaagacggcacgttgcaggacacgctggaaacttaacgtcggctgcgtatcacgctcttcttcactggcaggcagtacgggtgtggtttgttcaatgaaggcttcgagttcctgacggagcgccaccagatccacggagcatgcttccagcgcttcgcgagccgatgggttgctgagcagcgccagcaacagatgctcgacggtcataaactcatgacggtgctcgcgcgctctggcgaaagccatgtttaaactgagttccagttcttgattgagcataggcacctcccccaatttttatacctgcattcaggctttttccagcgtacacagcaacggatgctcgttctcccttgcatacttgttcaccatcgccactttggtttccgccacctcggcggtaaacacgccgcagatagctttgccttgatagtgaactgcaagcatcaattgcgttgcacgttctacatcataagaaaagaatttttgtaacacgtcaataacaaactccatcggagtgtagtcatcattgactaatatcactttatacatagatggcggttttagcgcgtcgcgcacgctatcttccaccaactggtcaaaatccagccaatcgttcgtcttacccattgtcagtcgtcattatcggttacggttgtcggcaggaaaatctgccgctgaccagagtctatgcacacaatcaatctacctcaattgatagataactaacatctatcagtaccatccacgacatctgtcacattcccggcaatagcgttaactgcttcaaatttttgattcatttttacccgatcccccctgcctgatgcttgacgcctcgcctgatttctctaaattgtaatgtcgagagttggtgaggttttgaacagcccccactccgtcaccggttcattccatcttacttatataagatttacgaaggatgtcgaagcatggaaacgggtactgtaaagtggttcaacaatgccaaagggtttggtttcatctgccctgaaggcggcggcgaggatattttcgcccattattccaccattcaaatggatggttacagaacgcttaaagccggacagtctgtccggtttgatgtccaccaggggccaaaaggcaatcacgccagcgtcatcgtgcccatcgaagcagaggccgttgcatagctcctctgtctcattgtgtacatccagaaggcaaaatgccagcccgatcggctggcatttttatttaacgccagtgcctggtggcgacactgttgcatcttatcaggccgacaaatgacgtcagcaagattactctcttgccagcgcatccaccgggtccagtcgcgccgcgtttctcgccggtagccagccaaacaatatcccggtaaacgtcgaacataaaaacgcgctcgccagcgctgtcagtgaaaaaccgatctcccagccgggcaggaaaagctgtagcataaatgcgatgaacatcgacaagctaatccccagcgctccaccaaccaggcaaaccagcaccgcttcaataagaaactgctgtagcacatcgctggcgcgcgcgcctaccgccatacggatgccgatttcacgcgttcgctcggtgacggaaaccagcataatattcataacgccgatgccgccgacaaccagcgaaatgacggccaccagcgtcagaaataactgaagagtataggtggttttttcagccgttttcaggacgctgtccatattccaggtgaagaagtcttttttaccgtggcgtaaggtgagcaggcgggtaagctgctgttcagcctgatcgctatcaacgccatctttcacacgaacggtgatcgagttaagccatgactgacccattatgcgatctgacatcgtgctatagggcaaccaaacttgcaacagattgctattgccgtacatggacggtttctcttccgccacgccaataacaataaccggcatattacccaccagcaccacttctcctacgacattcgctttatttggaaatagctggcgtcgcgtgttggcatccaacaccaccacctgcgcgcgatcctgttgctgtacagcattgaaggtgttcccctccctaaaggacatgccgtaaacgttaaaataatcgccactgacgccattagcatttacggcaatatcaatattgccatagcgaagacgtaagctctttgaaacgctgggcgtcgcagagttaacccacggctgtttctgaatagccaccagatcgtcatatttcagcgcctgtcgatactgcgggttgtcgtcgccaaaatctttgcctggatgaatatcaatcgtgttagtgcccatagcgcggatatccgccagtaccatctgttttgcggcgtcgccgaccaccacaatcgacaccaccgacgcaataccgataataattcccagcatggtcagtaaagtacgcattttgttagcggccatcgctaaccacgccatcgacagcgcttcgcgaaagctgctggcaaattgccgccagccgggagccgtattaactacggcagcgtcaacgccctgttcgcgtttcttttcctgcgcgggcggattatggacaatcttgccatcgtgaatttcaataatccgctccgcctgggcggcaatcagcggatcgtgcgtcacaatgatcaccgtatgtccgcgatcgcgcagttggcgcaaaatcgccattacctcttcgccggaatggctatccagcgcgccggtcggctcatccgccagaatcacctgtccgccgttcatcagcgcgcgggcaatactgacacgctgctgctgtccgccagaaagctgtgaaggtggataatcgacgcgatcgcttaatcccagccgcaaaagcaactctctggcgcgcgcctggcgttttttgcgttcaatgccggcgtagacggcggggatttcaacattttgcgctgccgttaaatgcgacaacagatggtagcgctgaaagataaagccaaaatgctcacgccgcagctgcgccagcgcgtccgggtccagcgtcgagacgtcccgccccgccacccgataagtgccgctggtcggtttatccaggcacccgaggatattcatcagcgttgattttccagaaccggaaacgccgacgatcgccaccatctccccggcgtggatttgcagggagatatctttcaacaccgccacctgctcttctccggaggggtagctgcggctcacattgcacagttcaagcaatgccgtcatggcgtcgctcctggcctgctctcgccgatgatcacctcatcgcccgcttccagacctttaaccacttccacgtctgtatcgttacgctcgccaatgaccacttcgcgctcacgtttttcgccgttacgcaacagcgccactttataacgattaccgcccaccggctcgccaagcgcggcgagaggaataatcagcacatttttgacatccatgagttgaatataaacctgtgcggtcatatcaagacgcaagattcttttgggattcggcacttcaaaccgggcgtaataaaaaatagcgtcgttgatcttttccggcgtcggcagaatatcttttaaaacgccttcatagcgcgtttgcggatcgcctgcaatggtgaaccatgctttctgccccgcccgaagatggatcacgtccgcttccgagacctgcgcttttaccagcatggtgctcatatccgccagcgtcagaatattgggcgcctgctgagctgcaatcaccgtttgtccttgcagggtagtgatttgcgtcacttcccccgccatgggggcgacaatacgggtatattccaggttggttttcgcggtgtccaacgaggcccgattacgtttgatctgggcatctatggtgccaatacgcgcctgtttaaccgccaactccgtcgccgcagtatccagatcctgttgcgataccgcctgagtcttagctaactgctgctggcgcgccagcgtaacccgcgccagctttaactcagcggctgcctgctgacgctccgcgttcagctccatcagggtggcctcgacctcttttatctggttctccgcctgatctgggtcaatcacgccgagtagctgatcttttttaacgttatcgccaatggagaccagcagcgttttcaactggccgctcacctgcgcgccgacatccactttacgcaacgcgtccagttttccagtcgccagtacactctgttcaagatcgcctggccgcacgattaatgtctgataagttggcagcggcgcatttatcattcgccagctaaccatcccccccactaaaagaattaaaataatgaccagataacgctttttaaatttctttcccttagcacgcatagaaaccctgacggcaaaattttaaccagaaagtaaaccgtatctaaacaaacctgacgcaataaagatagcgccggctgtattgacgattggttaatgtttcctgtggttcaatctcgacaatcttatgtcgcggattacgatcatgacacagcttacagataatacctggtacacttcagattacatctctcctttacaattatttattcgtctgacgcgcgggcaattacagccaggaaaattctggcgtaaagccagctttcgtcgcaagtttttaatccgctcattagtcatgccgcgtgcaaccagccaattactgaccaatctcacccaatggccgaagttaaatacgttacttgctcgtcagccgcgtttgcctattcggctacatcgtccttatatggctgtaaatattaaacgcgatttcgccttagacgctctgtgttttcattatcaacagatgcgccaacttttatcgcgggaacaacaagttagctatttaagtcagtatggcctgaatcttgctaaatttgaagctaaaaccggcgagttgtttcaacttgatttagtcagtctggtctcactggataaagaaggtgaaagcactattgttgttcgcgacgcacagttacgtattctggcagagatcacatttaccctgtgtcgctttaaccaacaacgcacactatttatcggcggattacagggcgcggcaaacgacgtccctcacgaaattatccagcaggcgaccaaagcctgccatggtctttttcccaaacgcatcgtgatggaggctctctgtcagtttgcgcaagtctttcaggcagaaaagattatagccgtgagtaacgatgcgcacgtttatcgtagctggcgatacatggataaaaagacgcaaatgcatgccgactatgacgcgttttgggaatcgttaggcggtgaaagaattaaagggaattactatacgctgccgctggcgatcgcccgaaaaagcgaagcggagatcgccagtaaaaaacgggccgagtatcgccgccgctatgcattactcgatagcgtcgtcgaacaggttccggccacattcaaacgctaatccgcccggccccgcgccagccaaaccacgcgcgagaacatctttctgaacagcggcggcacggcgtcaattccgcgccgcccggcttccatcgcgacttcaatcgccaaatccggctttgacgagcggtggatagctttagtgataattttccgggtattcatcggcacattaagcggaagttgcgcaacccggtgaaaaacatcggcaaagccctgacgatacataaaatgttccatatccagcgtaggcagcgccgtgagatgttcgcgttcttcttcccgatcgttattaagcaggctgcggaccgtcgcggcatattttttccccgcttcgtcgccatccaccaggacatgccactcgattcccatacggcgggcgaacttcaccagcggtttcaggccagactgagcaaattcaatgactttaattccctccgcatcaaaatgatgtccacactgacgcgccagctcattaataacccaggtttccgtctcgccttccaccagtagccagcaacgcgcaaacagcgacgacgcgcgattaaagcggatatgaaaggcgatgcgccgtccatcttccgcgcttaacccgcccgtgcccagacgccaggcggcgacgcgggaagattcgcgcaccagccgtacgacatgctccaccggcgttagcgagagcagttcgcctgagttggttgtcgctatccgctgtagcggtaacagattgagcaattgccaggcgactgaaagcataatgggatgtaaacgggtttccggatcttccaccagcagtaatggtcgcgcgtctttatgtaaccgcagcgtccctttcgcctgtaacagcgtggagaaaagccccagcaggatcacccgatgcgaccggctgcccggtttgtcgatcatccgattaataatatccagatagcgccagctacgctgctcattttgcgaacgccggcgcatgagtcggtgacgcgcctgtcctgcgccctgctctgagaaatagtgttcaagcagttgcaccatcgcggacagtccctgacgaatctgcccgtcggttaaattttgcggccgggtcgccagctcacgcgccagaaaatccagttgccgggccgtgacttcaacatccggcacattgggcaccgtgccgttgcgaatacgtcgcataaagcgcgcatcgcgcaaacgtagcactggcatcagacgaaccaggtggcgcacctgatcgttaatattttccaccggcaatggctgcccatcgctattgagaaaactgcgcagcgtcatcacgctgccatcggcgccacattcgccctctagacgataaaaaatacggtgaaaatcatcctcgcaaggcgaccagcatgcttccagcgcccgataacgacgtacccgatgccgccctggctgcgtttcgcgaaaagtcagaataatatgcaggtgatgctcgcgtccttttatgtcgccaggcggaaaccagaaatcctcacggacaaaatggtagagatcgagttccggcgacaataacagagtcagcgcatccagcaggctggatttgccccaggcgttttccccaatcagcacgttgttttgctccagcatcaacgatagtcggttgataccgcgaaatcctactatttcaacgcgttcgagaatcatgcttcctccagaaaaacgtcaccactccattaaactcaccgcagtataacggcaaatgcttccgcctggcgtgatattcccccctttgcctggggcaactgtctgataaatgtacggctgacggtgtcgctttactgatagtctggaattcggtagtgtcatgtacgctattcaaacaataaaaaagggcccggctgttcatgttttcaggacttttaatcattctggttccactgattgtgggctatctcattccactgcgacataaagccgcattacaactcattaaccggctactgagctggatcgtgtaccttattctcttttttatgggaataagcctggcgtttttggataacctcgccagtaatctggtggcgatttttcattattccgccgtcagtattacgattattttattgtgtaatatcgccgccttattgtggctggaacgtatcctcccgtggcgtcaccatcatcagcaggaaaaactgccttcgcgtattgccatggcgctggagtcgctgcaactgtgcggcgtagtggtattggggtttatcatcggcctgagcggactctctgttttacagcacgccaccgaagccagtgaatatacgctgatctttttattgttcctggtggggattcagctacgaaatagcggcatgaccttaaagcaaattgtgcttaaccgccggggaatgatggtcgcggtcgttgtcgtggcaagctcattactgggcggcgtgattaatgcgtttatcctggacttaccgctaaaaaccgccatggcgatggcgtcaggtttcggctggtactctctttccggtattttgctgacggagtcgtttggaccggttatcggcagcgcggcattttttaacgatctggcccgcgaacttttggccattatgcttattcccggtctggttcgccgcagccgttcaacggcgttgggcctgtgcggagcgacctcaatggactttacgttgccggtattacagcgctccggtggcgtagagattgttccggcggctatcgtacatggctttatcctcagcctgctggtacctctcttaatggcgttcttctcggcctgatacctctctggcggtaggtatctgccgccaaaattgcgctaaatcaatctccttgcacattatggcagaaatcccttttatccctttgttcacaggcataatcttaaacatgtatattaaatataactttaaaaggtgtgaccatgttttgtgtgcaatgtgaacaaaccatccgtacaccagccggaaacggctgctcctacgcgcagggaatgtgcggtaaaacggctgaaacgtccgatctgcaggatctgctgattgcggctttgcaaggtttgtctgcctgggcggtgaaggcccgtgaatatggcatcattaatcacgacgttgataactttgcgccgcgcgcgtttttctccacgctgaccaacgttaacttcgactctccgcgtatcgtcggctacgcccgtgacgctatagccatgcgtgaagcgttgaaagcccagtgcctgagcgtggatgctaatgcgcattgcgacaatccgatggccgatctgcaactggttagcgacgatctgggcgaactgcaacgtcaggcagcggaatttaccccgaataaagataaagccgccattggcgagaacatcctcggcctgcgtctgctgtgcctgtacggtctgaaaggcgcggcggcgtacatggaacacgcgcacgttctcggtcaatacgacaacgacatttatgcgcagtaccacaaaatcatggcctggctcggcacctggcctgctgatatgaacgcgctgctggagtgcgcaatggaaatcggccagatgaactttaaagtgatgagcattctggatgccggtgaaaccaccaaatacggtcacccaacgccgactcaggtcaacgtcaaagcgactgaaggcaagtgcattctgatctccggtcacgatctgaaagatctctacaacctgctggagcagaccgaaggcaccggcgttaacgtctacactcacggcgaaatgctacccgcacacggctacccggaactgcgtaaattcaagcatctggtcggtaactacggcagcggctggcagaatcagcaggtcgaattcgcccgcttccctggcccaatcgtgatgacctctaactgcattatcgacccgaccgtgggcagctatgacgaccgtatctggacccgtagcatcgtcggctggccgggcgttagccatcttgaaggtgatgacttcgggccggtcattgcccaggcgcagcagatggcgggcttcccgtatagcgaaattccgcatctcatcaccgtcggttttggtcgtcagaccctgctcggcgctgccgatacgctcatcgatctggtcagtcgtgaaaaactgcgtcacatcttcctggtcggcggctgtgacggcgcgcgcggcgagcgtaactactttaccgatttcgtcaccagcgtgccggatgactgcctgattctgactctggcgtgcggtaaataccgtttcaacaaactggagttcggcgacatcgaagggctgccgcgtctggtcgatgccggtcagtgtaacgatgcttactccgcgattatcctggcggtgacgctggcggaaaaactgggctgcggcgtcaacgatctgccgctatcgctggtgctctcctggtttgagcagaaagcgatcgttattctgctgacgctgctgtcattaggcgtgaaaaatattgtcaccgggccgaccgcaccaggcttcttcacgccggatttgctggctatcctcaacgagaagttcggtctgcgctccgtgaccactgttgaagaagacatgaagcaattgctgagcgcgtaaggaggccaatgatgacgatgccaacctcacaatgtccctggcgaatgcaggtgcatcacatccgtcaggagacgccggatgtatggacaattgcgctattatgccatgactactacccttaccgcgccgggcagtatgcgctggtgagcgtgcgcaattcagcggaaacgctgcgcgcctacaccctttcgtctacgccgggcgtcagtgaatatatcacgctgaccgttcgtcggattgaagatggcacgggttcacagtggttgacccatgacatcaagcgcggcgattacatctggctgtctgatgcaatgggcgattttacctgtgacgataaaacagaagataagtttctgctgctcgccgccggttgtggcgtaacgccaatcatgtcgatgcgtcgctggctggcgaaataccgcccgcaggccgacgtgcaggtcatctttaacgtccgttcgccggatgatgtgatttttgccgacgagtggcgacagtatccggtcacgctagtggcggaaaatcatgccacggaaggttttatcgcgggccgtctgaccacggaattgttacagcgcgtaccggatttggcatcgcgcactatcatgacctgcggcccggcgccctatatggatttcgttgaacagggagtgaaagcgcttggcgtaacgcacttctttaaagagaagttcttcacgccggtggcggaaacggcaaccagcggcctgaaattcaccaaactacagccagcgcaggaattttatgccccaatcggtacgacgctgctggaggcgctggagagtaataaagtaccggttgccgctgcctgtcgggcaggtgtttgcggctgctgtaaaaccaaagtcgtttccggcgactatacggtgagcagcaccatgacgctgagcgaggcggagattgccgaaggttacgtactggcctgctcctgccatccgcagggcgatcttgttctcgcataatcggtaaacgttccatcgtaggcccggtaagcgtcagcgccaccgggcgatttaccactcgcttcatcctttcgcccctctctccgccaaagaaaaacgtcatcgtcatcttcaactaaacttgtaaccgttatcacatttaaggagatggagaaccatgaaacaaaccgttgctgcttttatcgccaaaacgctggaacaggctggcgtaaaacaaatctggggcgtcactggcgactccctgaacggcctgagcgatagtcttaatcgtatgggaaccattgaatggatgccaacccgccacgaagaggtcgccgctttcgccgccggcgcacaagcgcagcttaccggcgagctggcagtgtgcgccggttcatgtggaccgggcaacctgcacctgatcaatggcctgtttgattgccaccgtaaccacgtccctgttctggcgatcgccgcccatattccgtccagtgaaatcggcagcggttatttccaggagacccacccgcaggagttgttccgtgaatgcagccactattgcgagttggtttccagcccggagcagatcccgcaggtactcgccatcgccatgcgcaaagcggtgctaaatcgcggcgtctccgtggtcgtacttccgggtgacgtggcgctgaaacccgcgcctgaaaacgccgtcacccattggtaccatgccccgcaccccgtcgttacgccggcggaggaagagctgaaaaaactggcgcaactgctgcgctactccagcaatatcgcattgatgtgcggtagcggctgcgcgggcgcgcatgaggagttggtcgcgttggcggcaaaactaaaagcgccaatcgttcatgccctgcgcggcaaagagcacgttgagtacgataacccttatgatgtgggaatgaccggcctgattggcttctcttctggcttccacaccatgatgaacgccgatacgctgatcctgctcggcacccagttcccctatcgcgccttttatccgagcgatgccaaaatcattcagattgacatcaacccgggcagtattggcgcgcacagcaaagtcgacatggcgctggtgggcgatattaaagccacgcttcgcgccctgctgccgctggtggaagaaaaaagcaatcgtaaattcctcgataaagctctggaacactatcgggacgcccgtaaagggcttgatgacttagccaaactcagcgataaagccatccacccacaatatctggcgcaacaaattagtcatttcgccgctgacgacgctatttttacctgcgatgtcggcacgccgaccgtctgggcggcccgctatctaaaaatgaacggcaagcgccgcctgctgggctcgtttaaccacgggtcaatggccaacgccatgccgcaggcgctcggcgctcaggccaccgcgccgggtcgtcaggttatcgcgatgtgcggtgatggcggcttcagtatgctgatgggcgattttctctcggtggtacagatgaagctgccgataaaaatcgtcgtctttaataacagcgtgctgggctttgtggcgatggaaatgaaagctggcggttaccttaccgacggtaccgaactgcacgacaccaatttcgcgcgtatcgccgaagcctgcggcattaccggtattcgcgtggaaaaagccgcagacgtggacggagcgctacagcgcgcgttttccatcgatggcccggtactggttgacgtggtcgtggcaaaagaagagctggcgatcccgccgcagatcaaactggaacaagcgaaaggctttagcctgtacatgctgcgcgccattattagcggccgcggcgatgaagtgatcgaactggcgaaaacaaactggctaaggtaaaacagtgcacatcaccttttaaaatccagggatgtgccatgattgatttacgcagtgataccgttacccgaccgggccgcgccatgctcgaggcgatgatgaccgccccggtcggggacgacgtatacggcgatgcccctaccgttaacgcccttcagcgctacgccgccgacctttccggtaaagaagcggcgctttttttacccaccggcacccaggccaatctggtcgcgctgcttagccattgtgaacgcggcgaagagtatatcgtcggtcagggcgcacataattatctctatgaagctggcggcgctgcggtgctcggcagcattcagccgcagcctattgatgccgccgcggacggtacgctgccgctggagaacgtagcggcgaagattaaagcggatgacatccacttcgcgcgcacgcgcttgctcagtctggaaaatacgcataacgggaaagtgctgccgcgcgcgtatctgaaagacgcctggacgtttacccgcgaacgtgggctggcgctgcacgttgacggcgcccgaatttttaacgcggtggttgcctacggctgtgagttaaaagagattacgcagtattgcgactcttttaccatctgcctgtcaaaaggtctcgggacgccggtcggttcgctgctggtcggcaaccgcgattacattaaacgcgcgacgcgctggcgtaaaatggtcggcggcggaatgcgtcaggccgggattctggcagcggccggactgtatgcgctgaagcataacgtggcgcgtctgcaagaggatcatgacaacgccgcctggctggcgcagcagcttcgcgaagcgggcgcggatgtcatgcgccacgaaacgaatatgctgtttgttcgcgttggcgaagcacaggccgccgcgcttggcggctatttgcgggaacggaatatcctgattaacgccgcgccgattgtgcgtctggtgacgcatctggatgtctctcgcgaacagcttgccgacgtcgtcgcccactggcgcgcctttttagcccgctaaggagagcaacgtggcgcaacgcattctggtcctcggcgccagcggctatatcggtcagcacctggtctttgcgctaagtcagcaaggacatcaggtgcgggcggcggcgcggcgcgtggaacgtctggaaaaacatcgcctcgccaacgtcagttgtcataaggtcgatctgcactggccggaaaatttacccgcgctgcttcgcgacattgataccgtttactatctggtacacggcatgggcgaaggcggcgactttatcgcccatgagcgtcaggcggcgctcaacgtgcgcgacgcgctgcgccagacgccggttaaacaacttattttcctcagttcattgcaggcgccggcgcatgagcaatccgatcacctgcgcgcccgccagcttacggctgacacgctgcgcgacgcaggcgtaccggtgacggaattacgcgccgggatcatcgtcggcgcaggctccgccgcctttgaggtcatgcgcgacatggtttacaacctgccaatactcacgccgccgcgctgggtgcgttcgcgcaccacgcccatcgccctggaaaatttactctactacctggtcggcttactggagcaccctgcgcacgagcatcgtattctggaagccgccgggccgcaggtattaagttatcagcagcagtttgaacgttttatggccgtcagcggtaaacggcgtccgctgatcccggtgccttttccgacccgctggatttcggtctggtttttaaacgtcattacctccgtgccgccaactaccgcaaaagcgttaatccagggattaaggcacgatttgctggccgatgacgccgcgttaaaaaagttgatcccccaaacgcttatcacctttgatgacgccgttcgccgcacgctgaaagaagaagaaaaactggtgaactccagcgactggggctacgacgcgctggccttcgcccgctggcgtcccgaatacggctattttccaaagcaggcgggctttaccgcgcagaccccggccagcctatcggcgctatggcaggtcgtaaatcggctgggtggcaaagagggctattttttcggcaatattttgtggcagacgcgcgccgcgatggaccgtctggtggggcataaactggcgaaaggccgcccgtcgcataccttgctcaagcctggcgatacggtagatagctggaaagtgatcattgtcgaaccagaaaaacagctcacgctcttgtttggcatgaaagcgccgggtctggggcggcttagcttcacgctgcacgataaaggccgctaccgcgaaattgacgtgcgcgcctggtggcatccacacggaatgccgggcctgatttactggctactgatgatcccggcgcacctgtttattttccggggaatggcaaggcgtattgcccgacttgcagaacaaatcacagaaaaatgagaaaaagttgctgtattctttcgtgtttcccattgcataccgacgtaattcacggaagaatgcgcacgacggtttattaaacacagtggattgatatgaaggtactggttaccggcgccaccagcggcttaggtcgaaacgcggttgaatttttgcgcaataaaggcatcagcgtcagagcgacgggtcgcaatgaagcgatgggcaagctgcttgaaaaaatgggcgcggaattcgtccatgcggatttaaccgaactggtctcctcgcaggctaaagtgatgcttgccgggatcgacacgttgtggcactgctccagctttacctcgccctggggaacccaacaggctttcgatctggcgaatgttcgcgccacccgccgtctgggagaatgggcggtcgcctggggcgtgcgcaattttattcatatctcctctccctcgctctattttgattaccaccatcaccgtgatatcaaagaagatttccgcccgcatcggtttgccaatgagttcgcccgcagtaaagccgccggcgaagaggtgattaatctgttggcgcaggccaatccgcaaacacgttttacggtattgcgtccacaaagcctgtttggcccgcacgataaagtatttatcccacgtctggcgcatatgatgcaccattacggtagcgtcttattaccgcacgggggcagcgcgctggtcgatatgacctactatgaaaatgcgatccacgccatgtggctggccagccagccgggctgcgatcatctgccttctggccgcgcttataacatcactaacggcgaaaaccgcaccttacgcagcatcgtacaaaagttaattgatgaattgactatcgactgccgcattcgctctgtgccttacccgatgctggatatgatcgcccgcagtatggagcgcttcggcaaaaaatccgccaaagagcccccgctaacgcattacggcgtgtcaaaactgaattttgattttacgctcgatacgactcgcgcgcaggacgagctgggctaccagcccatcgtcacgctggacgaaggcattgagcgcaccgccgcctggctgcgcgatcacggaaatttaccgcgttaatcctggccgtacttctccagtaatgcttcggcaatcgcctgcgtttcggcatctgcgataccgttccattgcgccggacggaagtgcatctggaacgccataatcacccgctgttgctcgcgcgccgtcatatcggctttgacttcatagccatagcgcgagagtaacgcaagcaccgttgcggtatcgactggcgtatacggcgcgcgtccagccagataaaacgccacacgctgggcgtcaggccaggcgccaatcccctgtgccgccagctcgcgccacgggaagcgcgggccgggatcgtctttacgctgcggcgcgatatccgcatgggccaccacattctgcggtttgatgtcatagcgcgcgataatgtccttcgctaacgggatcaatgcctgaatttgcgcggattcaaacggcgcgaaagatttcaccccgccggacattcgccagccgcgattttccagctcaatgccaatagacgtatcattgagacgcgtggcgcctcgccagaaactgacgcccgcatgccaagcctgatcctgttccggcaccagttgccagatgcgcggtttaccgccatataatggcggggttgcgggaatcaggtaatgcgaactgacgttgcgacccgttaacgtcgccagcgaaacgtcaaagttttccgccgtatagtgaatcaccaggactttaatgcgcggataggccgcctgcgcccgatgtcgggtatcaagctgatatccctctttatcgataattcctttttcgctcgcgcagcctgttaacagcaacgcgagaccaaccagccacagtagcgctttcatcggcgcgttttcaccgccgttccgctgacgctgaccatcagcatactgccatccttgccgacagtttcgtaatcaatatcgatgcctaccaccgcatcggcgcccaacgctttagcctgctcgccaagttcctgaaaagcgatttcacgcgctttacgcagctctttctcatacgcgccggaacgtccgccgacgatatcccgaatgccggcgaaaaaatcgcggaaaatattggcgcctaaaatggcttcgcccgttaccacaccgcaatactccacgatgctttgtccttccagcgttggggttgttgaaaactgcatagtgaatctcccgggttagctaagcacacgatctcaaacgcattatcaagctgatacgctatcattgaaaggatataattgattatcgtagatcggtttttgctcgatcgcctataaggaaatcatcatgcgctattctaaactctctttgctcatcccgtgcgcgcttctgcttagcgcctgtacgaccgtcactcccgcctacaaagataatggcccgcgtatcggcgcgtgtgtggaaggcggcccggacagcgtggctcaacaattttacgactaccgtattcaacaccacagcaatgatatcgccgcgcttcgcccctacttgagtgataacctggcgaaattgttgaccgacgccagccgcgatacggaacaccgccagttgatgagcggcgatatgttctccagccgcgctacgctgccggatagcgccaacgtcgccagcgcatcaaccattccgaaccgagatgcgcgcaatattcctctgcgggtggcgttaaaacagggcgatcaaagctggcaggatgaagtgcttatgattcacgaaggctcatgctgggtgattgacgacgttcgctatctgggcggagatgtccatgcccctgccggtacgctgcgccagtcgatagaaaaccgttaacagtcagtattccccgcttttgcacccataaccccgtaaattgtctggcattctgcacgggatgccgacaattcttcttacctactattcctcctgctattttgtgctatgtttagggaagaatgtgggatatatttaacttttaacgcataaatattgcataactattctgcgaaaggtactatctgcggcttcaatagctatcagactgcctgtatacgagtgtcaatgagtattcaattaaacggcattaattgcttttacggcgcgcatcaggcgctgttcgatatcacgctggattgccccgaaggcgaaacgctggtgttgcttggcccaagcggggcgggtaaaagttcgctgctgcgtgtactcaatctgcttgagatgccgcgctccggcactctgactatcgccgggaaccattttgactttacgaaaacgccgtccgataaggcgattcgtgagctacgtcaaaatgtcggaatggtctttcaacaatataatctttggccgcatctcaccgttgtgcagaatctgattgaagcgccctgccgcgtactgggtctgacaaaagatcaggcgctggcgcgcgcagaaaagctgctggagcgtttacgtctgaagccctatagcgatcgttatccgttgcacctttccggcggtcagcagcagcgcgtcgcgattgcccgcgcgctgatgatggagccgcaggtgctgctgtttgatgaaccgaccgccgcgctggacccggaaattaccgctcaaatcgtcagcattattcatgagctggcggaaacgaacattactcaggtgatcgttacgcatgaagtcgaagtggcgcgtaagaccgccagtcgtgtgatttatatggaaaatggtcacatcgtcgagcacggtgatgcgggttgctttgctcaccctcagaccgaagcgttcaaaaactatctctctcactaagattcgggacaatgacaatgaaaaaagttctgattgccgcgctaattgcaggctttagcctttccgctacagcagcccagaccattcgttttgcgaccgaagcgtcctatccgccgttcgaatcgatggatgctaataacaagattgtcggctttgacgtcgacctggccaacgcgctatgtaaagagatcgacgcctcctgtacctttaccaatcaggcgttcgacagcctgatccccagcctgaaattccgccgcttcgacgctgtaatggcgggaatggatatcacgccggaacgtgaaaagcaggtgctgtttaccacgccatattacgacaactccgcgctgttcgtgggtcagcagggcaaatacaccagcgtcgatcaactgaaaggtaagaaagtcggcgtacagaacggtacgacgcaccagaaattcatcatggataagcatccggaaatcaccaccgtaccgtatgacagctatcagaacgcgaagctggatctacaaaatggccgtatcgacgctgttttcggcgacacggcggtcgtgaccgaatggctgaaagccaatcctaagctggcgccggtcggcgataaagtcaccgataaagattatttcggcaccggcctgggtatcgcggtacgtcagggcaacaccgagctgcagcagaaattcaatactgcgctggaaaaagtgaagaaagatgggacttacgagaccatctataacaaatggttccagaagtaatctttgatgaacgaattttttcctttagcaagcgccgccgggatgaccgtcggccttgccgtctgtgcgctgatcattggcctcgcgttagccatgttctttgccgtctgggagtccgtaaaatggcgcccgattgcctggataggctccgcgctggtcactattttgcgcggcctgccggaaattctggtggtgctgtttatctatttcggctcctcgcaactcctgcttacgctgtctgacgggtttaccctccatctcggttttacgcagatcccggtgcaaatggagattgagaactttgacgtcagtccgttcctgtgcggcgtgattgcgttgtccctgctgtatgcggcctatgcgtcgcagacgctacgcggcgcgctgaaagccgttccgtctggtcagtgggagtcgggtcaggcactgggattatcaaagacggcgatttttttccgtctggtgatgccgcagatgtggcgtcacgccctgccagggctgggtaatcagtggctggtgttgctaaaagatacggctctggtcagccttatcagcgttaacgatctgatgttgcagaccaaaagtattgccacacgcacccaggaaccgtttaactggtacattattgcggcggctatttacctggtcattacgctgatcagtcagtacattctcaaacgcatagacctgcgcgcaacacgttttgagcggaggccggactaatgcttgagtacttacctgaactgctaaaagggctacacaccagcctgacgctgaccgtggcttctattgccgtcgctttggtgctggcgttagtttttaccatcatcctgacgctaaaaacgccgttcgtggtgtggctggtgcgcggctatatcacgttgtttaccggtacgccgttgttggtgcaaattttcctgatctactacggacccggtcaattcccgacactgcaagagtatccgctactctggcatctactgtctgaaccgtggctgtgcgcactgatcgcgttgtcgctaaacagcgccgcttacaccacgcagctattttatggcgcgattcgcgcgattccggaaggtcagtggcagtcctgcggcgcgctggggatgagtaagaaagatacgctggcgattttgttgccctatgcgtttaaacgcgccctctcctcctattctaatgaggtggtactggtcttcaaaagtacctcgctggcctataccatcaccttgatggaggtcatggggtacagtcagttgctctatggtcgtacctacgatgtggtggtatttggcgcggcaggcgtaatttacctggtcgtcaacggtctattgacgctgatgatgcgtttgattgagcgtaaagccctggcgtttgagcggcgcaattaaccaggcaggataaggcattctcgccgccgttcgacaatggtcagatggcgctgcgcttatcaagcctacgatgcataatattgaataaacccgacggacaagtggttaacttgtccgtctttttttatccattttaaaatatttaatcatttttattgcatacaaattcaattgatggcattgtaaatctatgccgcagacacggcgcataatcataagattacgggagtgacatcatgaaaaagttagttctggctgcattactcgcctctttcgccactggcagcatcgccgctgaaaaaatcaatttcggggtttccgccacctatcccccgtttgaatccctggatgcgagtaataaaattgtgggcttcgatatcgatctggcaaccgcattatgcaagcaaatgcaggcagaatgtacttttaccaatcatgctttcgatagtcttatcccggcgctgaaattcagaaaatatgatgccgtcatttccggaatggacattaccccggagcgcagtaagcaggtcgcctttagcaatccctattatgcgaactccgcgctggtgattgccaaaaaagacacctataaaacctttaccgatctaaaaggtaagcgtatcggtatggaaaatggcaccacgcatcaaaaatatctccaggataaacatccggaggtcaaaaccgtggcctacgacagctaccagaatgcgattatcgacctgaaaaatggccgtattgacggcgtctttggcgataccgcagtggtcaatgagtggctgaaaacgaatccgcaactgggtccggcaacagagaaagtgaccgatccgcaatacttcggtaccggacttggcatcgcggtgcgcccggacaataaggcgttgctggaaaaactgaataatgcgctggccgccattaaagcggacggcacttatcagaaaatcagcgatcagtggttcccgcagtaaaacgtatgtgattagcccaccgtgttgcgaaatggcagtataaataccttattcagcccacgggccgctatcggaaactatcctggcctgataagcgcagcgccattgagcattctacagtttgtcatcagtctcaaaggcctgcatcaacaggcgattcggactcatacttgccgggtgacgctaacgcgtacccggcttacaacattgttatgtttttagacaacatccagacccagacggcgatactgctccgccggagcgtcattttctttcatcaaacggataagtaagttgatcatccttacttcgatggcctcatcatgaataggatgttgctgctgcggatcgtctctgagatcaaacaagagatgaccaaagctattcacacctttatatttttccctggccggaatacgtaatacctgaagccctttagtgaatttaaacggaggtgccagagataattttcccagttcatccacgtcataacgcgcattcatcttgatcggcattaacgtgtagttcgcaatgtcatgctcacgccccggctgcgcggcccgcatataaacatagcgtccgtcggtaacattaacatgtccgctaaacacgccaaacagcgcgccttccctgacgggttcatcactggcaatgactttcgccagaggttggccctgcatatctgcgggaataggttgctgaaaataatccagtagcgttggcgcccagtcaatcatctgcaccagcgactgccgtcgcgctccgcataccgcgctgcgcgggtcccagataaacagcgggttattcgccacctcgttataatagggcatttgatttttagcccaccaaccgtgctcccccagcaagaagccgtgatcggtaccgacaatcagcatcgtatcgcgccagagatcgtgttcatccatcagatcaaggatacgtcccagattgcggtcgcacatggaaaccagggcccgataacgacagcgaatatgcgctatcgcctcctcactttcactgactttgccgcgcggccagtcataatgcgagccttgccactcatcgtcatagagcgataaatattcctcggtggtataaaacggctcatgcggatcgaacgtctcaacctgcaataaccagttatcttcggcatgatttttatggataaaatcgcacccggcgtcaaaaactttcgtctggggaaaatcggcttcctgctggatgtattcgcggttcgcccagtcatgacgccatagcccggaaacgccgcctccggtttgtttttgtggaacgcgcagtacttccggaatgggcggctcgccaacacttgccttccagtgatcgccctcctgaccgcgtactacgtcccaggagctatagcggttatggtagttaccgccgccgtcttcccagtaatgcagatgatcgctgataagatgggtgtagatccccgcttttttcaataattccggcatggaatcatcaaagggttccagcggcccccactcacgatgcaggaaattatagcgcccggtgtgcagttcccgacgggctggcatacagggcatactgccgacataactattgtcaaaggtggcggcatgtgccgccaggcgttgaaagttaggcgctttcgttagcaaatcaccatagggcggcaaatagtttttattcagactgtcaaacagcagaataatcgctttcatgactcaccctcatttgttgagcaggtgcggaaaatttttctctaccacatcgtaaatctgtttacctattgattcgctatccatgatattttcaatgggaatgagatattgtccgtgtttaggatcgaggctaacaacatcaagcaattttttcgaaatcgcataaatatctgcccagtcggtaaatccaccgacctctcccgctgccgtatgctccatatcaaaagagaagtcatattttgctaacgcttttttaacaacagtctgtaacattacgctactgcctacaccataaccgcatacgaataaaatatttacagaatctttcataataaaatcctttatatataaaccgaatcaattaaatggaataaggaccaagatggaacgttgaagcaataaatttcagtaattcacaaatcgcaggccacagagtcgcccagtcaaatattcccgtccagcccacgccttcttttgccagcccggttaaaggaatggcccataccgtaccgaaagtctgaataatccctaacaggaaagtacaaataataacggaacgatatccccccattcggttggctaatacgccgatgggaccgccggaaaagaagagcggaacaaaaccaggcaataccataatagggctatggatgagcagcaggatgcccatggaaaaaatcgtgccgaaagtacaaaagacgaatcccagcgtggccgcgttaggcgaaaaaggtaataaagcagcaacatccacagccggtatggcgttaggaataaagcgatcctgccatcctttaaacgaaccgttaatttcaccaaccatcatccgcacgccctgcagcaagatgaccatatacatagagaattgcaggcccagattgataatatagatataccagggtttgcctttcgccattaactgtacgttatcgatccctgtcgccaatagaaaaccgccaacgaagagcgtcatcacaatggcgattgccgtcacgttgtggttaaaaatagctaaccaaccgggaagtttcaggttttcggcgtcatgcttttccggatcgccgaatttatgcgcgaatttcgagaaaaaccacagccccagcatctggttatgcgcgatggtaaaaccggcgttattggtcactttggcgatgggtttaacaataagcgtggttgaaaacgcccaaaagaccccggtcaataccccggcaatcacaatggattgtacccaaccgaaccctagccagaagacgattaaccacagtaccgcctgtgaatgagagaccccggtattaccggtaagaaatataccttttgcgccggtataacggccaaataaaactaatatcaggttagtaaaaaacgccagtacaaaaacgtatcctacatagccgaaattatcgcccagcgctatttgcgtcgcagctttcatggcgtatgaatccattaagtatccatgtacgccataagccttgctgactgcttctgcaaccggtttaaaagtggctgaaaattgaaagccgccaaataacaccatcattaaaccgaccatcgcgctgatcataccggtgataatttttataggcgtctttttatccagcgcatagccaacaccgactaatatcccaattaatattgccggttcagttaaaaacgtttgaataacatctataaatttggcaaacatcgtctgaacgccctccataagcgtgtctattcgttgtcataattaacccctttactgacgttacgtattgcttcgctgatgctattgaaagttacccgataaaccaccttgtctaattttgccttacacgcactgtaataatcaaaattagtcattaaaagatttaaagtgattatttgtgatttgatttgcaaaaatagggtaatatataaccatgatcgatcggagtttttcatcgatcgatcatggttattattatttatggataattagacagttaatatagatattttgtatgcttggcttttggcgctacagcctgcaaagcagtgttaacacttcataatgcgcggtatgggggaacatatcgaaaagctgaacacgttgaatacggtagttcggcagatggcgaatatcctgcgccatcgtctgcgcgttacagctcgaataaatgataaaacgcggcgccatttgtgcaaggtaatcgcacaacggcttgccaatgccgcggcggggaggattcaccaacaccagatcgggcgtttcgccttgtgcggtggcgaattgggtggaatccagcgcctggaaatgaaggcgggttaatcccagctcggcagcggattgcttcgcgcaggcaatcgcctccggcgcgatctcaataccggttaattgcatctgcggcgtcgcgcagtgcaggccgaatccgcccactccgcaaaaaagatcccacatatggcgtaccggcaattgccctacccagtcgcgcgccgtcgcatataatcggctggcgaccgtagggttggtctgaaagaaactttgcggacgaatccacagcggcacatcgttaaaacgttccgccagcgcctgctgatccgtcagatagatttccgtctccccttccataatcgccatatgtaccggctggatattcgcggtgatcactctgagctgcggcagttgcgcgcgcagccacggtaacgccgcgcgcagttgcgtaagtttggtttctgaacgcaacacgaagcgtagcatcatgccgccatcgaactgactttccgtcagcaacaggtatttcagttcgccgcgttttcgcgccacgttataaggcgtgagtccggcacgggcaataaaaggttttagcgcgctgaatacgggggcaaaggaggcgggatacagcgggcaagcgcaaagatcgaccggcgtaccgtcgcgatgcagcatcccgaagagcggtttttctacactaccgctcacgaccattttcgctttgttgcggaaatgctgttccgggccgctaatcggcgcgcaccactgttcaacaggcagcccggccagcaaacgatgtaaatcggctgtttttgcggaaagttgttcgttaaccgactgcgtaatccattgacaggaacggcagcgacccgcgtcatagagtgcgcactgcataccaaaaaaccttcatattatccggggtgacgattatacacattattgcagccggaagaaccgacggctgggagcgggaataaacagcagaaacagaattaaaagatcggggagtttttgcatgaccagggaatgcaggatatcacgcttcgattctcccgcgatgctaaacaactccggatacccgtagcctaacgacgccgcccacagatacccactcacaataatttgtgccgccaggtacacccagcgcgcccagctacggcctttcaccagcgaaaacgcacaataaatttcaataaagaccagcactaagctggccagaaagaccagggttaagctccacgtctgcacgctgcgatgaataaactcgcccatcccgcgtatgccgagggtattcataatcatcagcacatcgagaccgcgaatcaaaataatcgccatagccgcaacctgcaccagcgtaggcacatttaaacgggcatgtgatgaggttgattgctttataaatcccaatgaatgtcttccctgaaaatgatgccgcgactcgcgcggcaacgcattgccatagtggaagattttagtggcttcagccgcgtcttgcacgctggatatcgcgaatccgctgtttttccgctcgcgccatcaggtaccaggcaataaatccgatgattcctaccacgccgaggattaacgtcgccagcgcgttgatttccgggttcacacccatgcgcacgctggagaaaaccagcatcggtagcgtggtggcgccgggaccggaaacgaagctggcaatcaccagatcgtcaagggagagcgtaaaggccaacagccagcccgagatcaccgctggcatgatcatcggtaacgtaatgacaaaaaagaccttcaacggcgccgcgccaagatccatcgccgcctcttcaatcgaacgatccagttcgcgtaatctcgaagcgatcaccactgccacataggcggtacagaaagtgacgtgcgccaaccagatggtcagcattccgcgatcggagggccagccgatagtatgaccgagcgcgacaaacagcagcagcagcgacagcccggtaatcacatccggcatcaccagcggcgcggtgatcataaacgcaaagccgtttgcgccgcgaaatcgtccaaatcgcaccatcaccaccgcggcgatagtaccgagcaccaccgccatcgtcgccgcgcaggcggcaattgtcaggcttagtcccactgcgctcatcatggcggtatcccgaaagagctcgccataccagcgcgtcgaccatcccgcccacaccgtcaccagcttcgaactgttaaacgagtaaatcaccaacattaacatcggcgcatagagaaaagtaaaccccagcaccagaatcagaatgcgccagggcgagcgaacgaccggtaagttattcatccgtgctcccccacacttttttgctgatgtttatggaaccacatgatcgggactatcagcagcagcaacataataatggcgaccgcagaagccaccggccagtcgcggttattgaaaaactcctgccacaggacgcgaccaatcatgatactgtccggcccgccaagcagttccgggatcacgaactcgcccaccgccgggataaaaaccagcatcgagccggcgatgattccgcctttggtgagcgggacaatgatgctaaaaaatgttttcatcggtcgggcgccgagatccagcgacgcttccaccagcgaataatcaatgcgcgtcaacgcggtataaatgggcagaaccataaacagcagatacgcataaacaatgccgatatagacggccaggttagtgtgcaggatcgtcagcggctgatcgataacccctagccacagcaacacattgttcagcacaccgttgtttttcaaaatgcccatccaggcatagacgcgtattaaaaaagacgtccacgagggcagaatcaccaacagcagcaggatattgcgcgtggagggcttgctgtgcgccaccgcccacgccagcgggtagcccagcagcaggcagcagattgtggaaataccggcaatttgtaacgattgcagacaggcttcgaaatagagcggatcgtcggtcagttgcaaaaaattgccgaggttgagcgtaatcgacaactgaccgtcagcccattccagcagatcggtatacggcgggatcgcccgcgccatttccgccaggcttatcttaaagacgataagaaacggcagtaaaaacagcagaatgagccagatataaggcaaagcaataaccagcttacgcccatgtttcatttgcattcgcgccaaccatagcgccgcgccgccaggtttactgatgcgtgccggaggttcaagtgtgctcatgtttcccccttataccgtcaggaccacgcagctatccgcttcccagcacaaacgcacttcatcgccccaggtcggtaaccctttccggtaacggtgcgcattctgcagttgagcgctgatcatctgcccgctttttagccgcacatgataaatagacagatcgccgagatacgcaatatgcgccacttcgccgacggcgaaattatagccatcggcaggcggcgactcacacagcatgattttttccggacgtagcgccacatataccggcacattatcaacgacagaggcatctgcatcgacttttaacggatgaaccaaaccgggcgcgtcaatgaccagaccgtcctcttcacgcgctttcagtaagccctcaaaaacatttaccgatccgataaattcggcgctatagcgggttgtcggatgctcgtaaatctcctccggttcgccaatttgcacaaattttccacggttcatgatggcaatgcgccccgccatcgtcatggcttcttcctgatcgtgcgtcaccatgacgcaagtcacgccgacgcgctcaaggatatccaccacttccagctgcatccggtcgcgtaattttttatccagcgcgcccatcggttcatccaacaagagcagcttaagacgtttcgccaggctgcgcgccagggccacgcgctgacgctgaccgccggaaagctgatgcggcttacgttttgcaaactcctgcatgtgcaccagacccagcatctcattgacgcggctggtaatctccgccttcggcagtttgtcctgcttcagaccaaaagcgatgttctgctctaccgtcatatgcggaaacaacgcataggactgaaacatcatattaatcggacgctgatacggcggaacatgcgccagatcgacgccgtcgagcataatttgcccgctgctcggcggttcaaaacccgccagcatccgtaacagagtcgattttccacaacctgacgcgcccagcagggcaaaaatctcacctttatagatagtcagactgacatcatcgacagcatgttgcccgtcgaatgacttcgtcaggttgcgaatttccagaagcggcgtcagcgctttacgggttttcacctgcgggcggtggggggcatcattcacaaggcgctctccggcataacacaatcaaacgatacaaacggtggaatgcccgatagcgcacgcttatcaggccataccgttaataaattacttaccgcttttcaccttcgtccatgcgcgggtgcggacgcgatcaatcttcggctcctgcactttcagggtaaacaacttggcccgcacatccgccggcggataaattcctgggttatcgcgcacctgctggctgaccagcgccgtcgcctctttattcgcattggcgtagaaaacgtgatcggaaatatgagcaatcacatcaaggcgcagcagataattaaggaactggtaggcctcgtctttatttttggcgtcagccggcatggcaaacacatcaaaaaatgccattaccccctctttggggatcgagaaagagatattgacgccatttttcgcctctttcgcccggttagcggcctgccagacatcgcccgcccagccgatggccacacaggtatcgccattagccagatcgttaatgtattgcgaggagtggaaatagcgaatgtttggccgtagcttcaacaacagatcggttgccgggccggtgtagtcatccgctttgctgctattcggatctttacccagataattcagcacggtggcaaaaatttcttcaggcgcatcaaggaaagagacgccgcagctttttagcttctccagattttccggcttgaggactaaatcccagctattcactggcgcatcatcccccagcaccgctttcactttatcaacgttatagccaatgcccgtcgtggcccacatatagggcatggcgtatttgttgtcaggatcgtgcttcgctaccagtttcagcagttcaggatcgaggtttttccagccgggaagtttgcttttatccagcggctgaaaaacgcccgcggtgagctggcgctcaagaaaactggccgatggcaccaccagatcgaacccggtgctgcctgccattaacttgccttccagcacttcgttagagtcaaagacatcatagataacgttaatcccggtctctttttcaaagttcgccaccgtgtccggcgcgatataatctgaccagttataaatgtgcagcgttttttgttcggcagcgagcgtgccgacagagacgaccatcagagcacccgcaaccagacccgatagccattttttctttaaggcggtcatcatcgctttccttctaaaatccgttaacaaatgaacccattaggcgtggtttaaaacatgcctgaaatgtgcataccttttcatttgatacaaatgaagaagagaggtcgccctccctgccatcaagctcgctatagaagcttcgcaagaataactttagctaaggtttgaggctatagcccagattaaaaaacgccttttatcaattttttatgcaggttttgtctatgtgataaagcgaaatggccagaaaggaggtgaataattctttaaataaaggttaacagcagcataaaaaaacgtaaacagcagccgcgctggcagcgactgcctgattatcgggagggatcagtgaagaaaatggtcaaccgcgctggttttttgcgcgtcttcttccgcgttaaacagaagctgatgcgccccggcctcaaggatcaccatagaaatctgctcttcactttggcgaacaaaccattcgaactgctcgtaggtgacgccttgcataacggataaagactggcacacaaccagttttggcagattatcatcctgcatatcgagaaaggcttttaccgtcaacgaactggcgttgatagcagagagatcggccgccagcggcagcaacgcggaaggcctgacctccgccatcgcggaaaaaagaacggtgttgtccaccaaattgattttagcatcgtagacgccgtcaaaattctgcatatgcggcaaatgcagcgcctggcaggtatcacattcgaagaaattcatgcccaggtcgtcgagccattgacgcaacgtatccagagtgggaacgaccagtgatatcataataatgtgctacctcttacgatgacgatgaaaaaattaccggcacagcttacgcaaaaagcgtgcttcgtactacggcggaatccacgattgcgattagccgccgattttaaggcaaaattcaggcgtagcgtgacgttctatccactgaatcattcgccccgcgatatccacgcccgtagtcttttcgataccttccagtcccggcgaggcattcacctccatcaccagcggcccgcgcgcggcgcgtaaaatatcgacacccgccacatccagccccagcgtctgtgcggctttgatggcgatatcccgttcacggggcgtgatcgtcgcgatgctggccaccccgccacgatgaagattggagcgaaaatcaccggctttcgcgcaccgctcaatcgccgccacaacctcattgccgacgaccagacaacgaatatcgcatcctttagcttcggcaatgtattcctgaaccaggatatgggcattcagcccccgaaacgcatcaataacgctttcagcagcctgacgcgtctccgccaataccacgccgatcccttgcgtgccttctaccagcttcacgaccagcggcgccccgccaaccatcttaataagatcgctggtatcatccggcgaatgggcgatcccggtaatggggagatcgatcccctggcgcgccagaagttgtagcgatcgcagcttatcgcgcgcgcgggtaatagcgacggattcattcagcggatagctacccagtagctcaaactgacgtagcgcagcggtaccataaaaggtaatggccgaaccaatacggggaataacggcgtcaaaatggggcagacgacgccccttgtaatggatcgacgacgctgccggattaatattcatatagcaggaaagaggatcgagtatctcgaccagatggccgcgccgcatcgccgcttcgcgcagacgtttgcaagaatagagcgttccatccctagacaatatggcaattttcaccctgcacctcgctgaaaaccctgaaaagcccgcgtatcatacactggcccgcaggttttagcgcgtcgcccagccctgtttatgcaaatattcaaggataaatgggcgattttctttaatcagggtgcgacggatatgatcgctccaggtatcgcgtcgcgtattactgccgcgggtcagataatactcagccaactgctcgtcatagcgcgccagcagcttttcatcaagcggttgatactggttctcatgaaccacaagctcggcaggcaggcgcggtttcagatccggattatccgcaggccatcccaaacacaggccaaagagcggcaatacatgcttcggcaattttaatagttcggtaacagattcaatattattacggatgccgctgatatacacgccgcctaaccccagtgattccgccgccgtcagcgcgttttgccccatcatcgccgtatcgacgacaccgagcagcagttgttcggcaagccccaactgcgcgtcaggacagatctgcaaatgacgattaaaatcggcacaaaatacccagaactcagcggcctgcgccacatgcttttgcccgcccgtcaggggcactaacgcctcgcgcagcgcccgatcggtaatacggattatagagctgcactgtaaaaaactggaactggacgtgctgcgcgcggcggcaataatggcctctcgctgcgcgtcagtcacgggttcatcggtgaaatggcgaatagaacgatggccacaaagaagttcaatggtcggactcattatgcttttctctatctgaacgggaagaaatgtcgggtggacgtttcatcaactgcggcgccagtaactgcgcaatacgccacatcatcgccaccgcggcggggaggatcaacacgacgcccaggaaaaccatcaatacgccagccagcgacgtattgaacggcgcgggcagcgtaaggtaatgattaagcgatagcagagcaagcgccagcaaaatcataccgaggcattccagtatcagtacgcttttgggtaacacgccgatcgtgcgcatatcaagcctcccggttaactgacgcacagtgtagaacgttctggtccggcgtgcttaacagatatagccctgagttatcaaaggaacaggcgtaacctgcttttcatctgccgtaaatcgcggcatgataacacctgttcgccgtctggctttatgttcgaggagagatatgtttactgttatttttggccgcccagggtgcccttattgcgtgcgtgcaaaagagttggcggaaaaactgagcaaagaacgcgacgatttcaactaccgctatattgatatccatgccgaaggcattactaaagcggatttggaaaaaaccgtaggtaaacctgtagaaaccgtaccgcagatttttgtcgatcaaaaacatatcggcggctgtacggattttgaagcatgggcaaaagaaaatctgaatcttttcgcctgattgctctggcgacgccctctgccggagggcgctatcggcgtttttttcgccggtggctaaacaggctgctaataaacaaatagcagagcgcgcctaacgcacaccagaatacggcgctaaataaccacgccagttcttgccaaaacgatcgggtaggcataaataccacgcgcattaacaccaggcaaaacggcgccgccagcatcgccccgatcagcggtcggatcacctcgcgtcggtgagaacaaaaactggccaccgcaccaagcaacgtaaaaaataacagtccaatctcaggatgccctgccgcgcgaaaagcgccttgtacatgcatagttaatgaaagacacaccacaataaagagtacaaagcagcagacaacgcttgcccacccgtgtttatgtttcaaccgttcctcctgacactctctatcgaacacgctttccgccgtgaggcatccagtcagataaagtcatgtggcattccatgccaaaaacacacctgcacaattcttatagccgttagtacgcaataagattaaactagcaggatatattgttgtgttgtttttatttggatgctgtatgcaatacgattgcacccttaattcatgataaaaacagtagcgtaaattaccatttctttcaacagcttactcgtaaacaagaagttagtctccgtgaatataaacgtcgcagatttgttaaatgggaattacatcctgttattatttgtggtcctggctcttggcctgtgtcttggcaagttacgtctgggttcagtccaacttggtaattccattggcgttttagtggtctctctattattagggcagcaacactttagtattaacaccgacgcgctaaatctgggatttatgctgtttattttttgtgtcggcgtcgaggctggccccaactttttttcgattttttttcgcgacggtaaaaattatctgatgcttgccctggtcatggtcggtagcgctctgctaatcgccttaggccttggtaagctattcggctgggatatcggcctgacggccggtatgctggccggctcaatgacatccacgcccgtgctggttggcgcaggcgataccctgcgacattccggcatcgccagcacccaactctcctccgctcttgataatctgagcctgggctatgccctgacctatctgattgggctggtcagtctgatcgtgggcgcgcgttacttgcctaaactacagcatcaggatttgcaaaccagcgcccagcaaattgctcgcgagcgcggtctggataccgatgctaatcgcaaggtttatttgccggttatccgcgcctatcgggttggcccggaactggtggcctggactgacggtaaaaacctgcgcgagctgggtatttaccgccagacaggctgctatatcgaacgtattcgtcgtaacggtattctggcgaacccggatggcgatgcggtgctgcaaatgggcgatgagattgcgctggtcggctatccggacgcgcacgccaggctcgatcccagcttccgtaatggtaaggaagtgtttgatcgcgatctgcttgatatgcgcatcgtgacggaggaaattgtggtgaaaaaccacaatgcggtcggtcgccgcctcgctcagctcaagctgaccgatcatggctgcttccttaaccgcgtcatccgcagccagatcgaaatgcctatcgacgataacgtcgtgctgaataaaggcgacgtgttacaggtgagcggcgacgccagacgcgtaaaaaccatcgccgatcgcattggttttatttcgatccatagtcaggtgacggacctgctcgccttctgcgctttttttatcatcgggttaatgatcgggatgattaccttccagttcagaaattttagtttcggcatcggcaacgcggccggattgctgttcgccgggatcatgctcggtttcctgcgcgctaaccatcctacctttggttatattccgcagggcgcgcttaacatggtgaaagaattcggcttgatggtatttatggcaggcgttggtttaagcgccggcagcggtatcagcaacggtctgggcgcggtcggcggacaaatgctgatcgccgggcttgtcgtcagcctgataccggtggtgatctgcttcttgtttggcgcttatgtgctgcgcatgaaccgggcgctgctgttcggcgccatgatgggcgcgcgtacctgcgccccggcgatggaaatcattagcgatacagcgcgcagcaatattccagcgctgggttatgcggggacttacgccatcgccaacgttctgctaacgctggcggggacgcttattgtcatcatctggccgggattaggataaaactgaagtttgcctttaagtgaaaaaattttgccaataggtcgaacttttcgttaaagcatcagtcatacctattgccactgcttttctttgatgtccccattttgtggagcccatcaaccccgccatttcggttcaaggttggtgggttttttgttgcccgacgcagagtgacacgacattgactctccggctattcgctttaccatctgtaaaatcgcttcacgcgccaacggcgttcgatccgtcacaaaatgcagcgtcatcccctcgataaacgcatccagcgcgcgggcggtctgtgcgtcaaaccactgcgccagcgtattctggctacgctgcatccagttttgcatgactatttttaacgctggcttatcgctggcataggcatataactgatacattaacgccatattatccggcgtcgtaacctgcgagccgtaaatcatttccgttatcgcctggcacgccccctccacatccgtcacctgcgcaaaaaaatcctggtattgacgcgacatgttctcggtgaaaagtgtaaaagcttcactcaataacgcatccataccggcaaaatagtaggtcatcgagccaagcggcacctgagcgatagcggcgattttccggtgcgtcacggcatgaacgccataggtctttaccgcttccagtgtggcctgaattattttttcccgtcgcttaggatcattggcgcgtcttacggcattttctttcatgatgagttccacatctcattcaggatgcaggcgatagtagcctgccgcttacgctgaaaaaacagacagcaaaaactgtctgcacaacgaagtatgacgacgatatgtacaaatgtacacaagcttgctaatgtttacctctcgcttctattttctggcctgacgctatgaccgtcctctcctcacgtaacgccttaaaacgccgtacctgggcgctgtttatgttcttctttttacccggactgctgatggcctcctgggcaacccgaacgcctgctattcgggatattctttccgtctctaccgcggaaatggggacggtcttattcgggctttctatcggttcaatgagcggtattctttgttccgcctggctggtgaaacgatttggcacccggaaggttattcacacgacgatgacctgcgcagtaaccgggatggttattcttagcgtcgcgctgtggtgcgcctcgccgctgatttttgcccttggattagccgttttcggcgccagttttggcgccgccgaagtggcgattaatgtcgaaggcgcggcggtcgaacgcgagctgaataaaaccgttctgccgatgatgcatggtttctacagtttcggcacgctggcgggcgctggtgtcggcatggcgttaaccgcattaagcgtcccggctaacatccatatcatcctcgcggctgccgtggcgatcgcgcccatttttatcgccattcgggcgatccctgacggtacgggtaaaaacgcatcggaaggttctcaccttcaggaaaaaggattacctttttatcgggacatccagcttttgcttattggcgtggtggtgctggcaatggcattcgccgaaggatctgcgaatgactggctaccgctactgatggtagacggacacggttttagcccaacctccggctctctgatctacgccggtttcacgcttggtatgaccgttggccgctttaccggcggctggtttattgaccgctatagccgggtgacggttgttcgcgccagcgcgttgatgggagcgttgggcattggcctgattatttttgtcgatagcgactgggttgccggcgtctcggtcattctttggggcttaggcgcttcgctcggcttcccgctgaccatttccgccgccagcgataccggtcccgacgcgccgacgcgcgtgagcgttgtcgccacgaccggctatctggcgtttttggtcgggccgccgctgttgggctatctgggagagcactatggattacgcagcgccatgatggttgtgctggcgctggttattctggcagcgctggtggcgaaggccgtcgccaaacctgtatcgactccgcaaccggtgatggagcataacgcatgagtattaaattaatcgccgtcgacatggacggcacttttctgagcgatcaaaaaacctataaccgtgaccggtttatggcgcagtaccaacaaatgaagcggcaaggcattcgctttgtcgtggccagcggcaaccagtattaccagttaatctccttctttccggaaattgcgcacgaaatcgcttttgtcgcggaaaacggtggctgggtggtcagcgaaggagaggatgtttttaacggcgagctggcaaaagccgacttccaggcggttgtcgaacacctgctcacacgcgccgatgtggagatcatcgcctgtggaaaaaacagcgcctacacgctgaaacggtacgacgatgcgttaaaagccgttgcggcaatgtattatcatcgtctggagtttgtggataatttcaacaatatcagcgatgtttttttcaaattcggccttaatattaccgatgaacggataccggaagtacaggcggcgctgcacgacgccattggcgatatcatggtccccgttcataccggctatggcagtattgatttaataattcccggcgtgcataaagccaacggcctgcgtctgttacagcagcgctggggcattcatgatagtgaagtggtggtattcggcgacggcggcaacgatattgagatgctgcgtcaggccgggtttagttttgccatgtcgcacgccagcgaagcggtcgcggcggcggcgaaataccgcgccggatcgaacaatcaggaaggcgtgctggatatcatcgacagcgtattaaacaacgagccgccgttcaacgtctagcggatgcctctctacgcctgataacagaaagcttatcaggcgtagccgctctctcagactgtttgcaaattccccgtccgcttatcttttaagaagaccagcatcagcagtagccaaagaataccgtttgccagattaaacaggctaaatagcccattgccgccgcttaaccaggcgtgtttactgacttcaatgccaacggtaaaaatcagcatttgtagcattcccatcgccgccgagaccgttcctttactcatatcgctggaaaagagcgtcagacgcaccagtccggcattcgccagcccaatgccaaaagcgtatacgcttaatcccgccgtcatccataaataagcatgggatgaaaccaccgtcgccgccgcggcgatgatcagccccgcgacgataggccagccgcccatcacgatcagcgagcgaaccgtacgtcgggaggttaaacgcgccaacaccagattaccggcaatgagcgcgccaaaaacgggcacctgcagcaaaccatattcatagctgctgagctgttcgccgctaatgatgataatcggcgactgcgcaatccaggccaacagcggcaggctgacaaatcccagcgctaacgcccctgcgacgaaccgccgattttttatcaccagccgataatcccggccaagcgccttaaatgacagcgtttcgccccgccgcgtggcggtctccggcattgcgcgctgtagcccgaaaaaggcgatagcggccagtgcggcaaataaaataaacatcccctcccacggcagaacatgcacccatgccgccccaactagtggtcccagtagcggcgcgattaacgccacgttcgccatcagcgcggtaatttttatacacaccgcctcctcaaaggattcctgaatcgcggcataccctacagcgccgataaaacacaggctaatcccttgcaaaaaacgcaggaatgtaaattgttcgatgtttttcgccagtaacgtcgccaggcaggtgacaataaaccacacgacgcccgccagcatcacgggacgacggccaatccggtcagacaacgggccaagcagccattgtaagaacataccgcccgccagataagcggtcatggacgtcggaacccagtccaggcccgcctgatactgctcaaccaccgccagcatacccggttggatcatgtcgttgccaatataagtagaaaactcgtacagcaccagacagagaggaaaaagcagcgcctgacgtcccagcctgccgcctgattgtaaacgattctgcataccatctcttcgccaataaaaaccgcgcagagtgtaatgaaagtcggggaactgagatagcgaattatgaggctgcaagggaaatagcgcacatttttacagaaagctgcttagcgcttgcgtactttaaggttaatttaagtttgcgccgttatcatcaacgttattttatgccattgtcttaaatctcttcatgttgccgccaaataagacaatactgcttttcctccctgttacgctgcatttatgctcagtttgcacggggatgagctggctatcccttttgatttcattgctccgagcctggatgttatgctggaaaaccttaacaactcgctgttttattttattaacgccacgcctgattccgcgcagtggataatttcgctcgctatctttatcgccaaagatgtcatcaacatcgtcccgctcttagccgtggtactctggctgtgggggccccgcgatcgggtctgcgcccagcgccagctgatcgttaaaatcggcatcgcgctgattatcagtctggcggtctcctggacaatgggacaccttttcccgcacgaccgtccgtttgtcgatcatatcggctataacttcctgcatcatgccgccgatgactcgttccccagcgatcacggtacggtgatttttacctttgcgctggcgtttttgttctggcaccgcctctggtcaggcatcgtgatgatggcgatagccatgaccatcgcctggtcgcgcgtctatctcggcgtacactggccgttagatatgattggcgcgctgctggtagcgatgcttggctgcctgagcgcacagctgatctggcaatggtacggcgcgccgctctaccaggcgctgcaacgttgttaccgtttctgtttcgcattgcccattcgaaaaggctgggtacgtgactaaatagcgaaaaaaagagtaatattaagcgctctgtatggtgcggagcgcttatttaactctccaggggaactatggaaacgcgacgcgacgagcgtattggtcaattgctgcaggccttaaaacgcagcgataaacttcatcttaaagaagccgcgaccctgttgggcgtctctgaaatgaccattcgtcgcgacctgaaccataaaagcgcgcctgtcgtgttgctgggcggctatatcgtactggagccccgcagcgccagtcattatctgttaagcgatcaaaaatctcgtctggtggaagaaaaacgccgtgccgctcagttggctgcgggcttggtacaagcgcatcagacggtatttattgactgcggcaccaccacgccgtggatcattgaagctattgataatgatcttccctttacggcggtgtgctattcacttaatacctttctggcgctgcaggacaaaccccattgccgcgccatcctcagcggcggggagtttcacgccagcaacgccattttcaaaccgcttgatttccatgaaacgttaaacaatatttgtccggatatcgcgttttattccgccgccggcgttcataccagtaaaggcgctacctgctttaatctggaagagctgccggtaaaacattgggccatgacaatggcccagagccatgtactggtggtggatcacagtaaattcggcaaggtacgtccggcgcggatgggggaattatcacgctttgatacgattatcagcgaccgccgtcccgatgaggcctttgtggcctacgctaaagcgcaacaaattactctgatgtattaaccgcaggtttgccggatgcgacgcgcacccggcaacggggttattttacgagaaccaactgccaaaccactgatggagtttcatcagcacaaaatcccacatacggctgaaaaatcccccctcctcgacgttttccatcaccattaacgggcgttgctcaatggattttccgttaagctggaaatcgatggtgccgacaacctgccctttcttcaatggcgccgtgagctgtggttcgttcaacgtaaagctggccttcaggtttttaagctgcccacgcggaatcgtcacagaccccgcatcgcccgctcccaaattgacctcacgcttatcgccaaaccagacccgttgcgtcacgaatgtcgcgtcaggtttaatcggcgtgaccgtttcaaagaagcggaaaccccaggtcagcagtttttctgactcattaaaacgaatacggtccgttttcgcccccagcacgacagagatcaggcgcatatcgccctgggtggcggaggcgacaaggttatatccagcgcctgccgttgtccccgttttcatgccgtcgacatgcagattggtactccacaacaggcggttgcggtttggctgacgaatattattaaaagtaaattctttctctttatgaatggcgtattcgtcaggcacatcgtgaatcaaggccttgccgagcagcgccatatcgcgagcggtactgaactgccctggcgcatcaaggccgtgtaccgtctggaaggttgtattggttaaccccaatcgtttcgcataggcattcatcaggccgataaaggactcctggcttccggcgacgtagtcggcaagcgcgatacaggcatcattacctgactgaatgatgatgcctttattaagatccgcaaccgacacctgatcgccgggcttcagaaacatcaccgacgacccacgtagcgccgggttccccgtcgcccaggcatctttgcccaccgtcaccatatcggtcagcttgattttgcctgccttcagcgcctggcccaccacgtagctggtcataatttttgtcaaactggcagggtcgagtttctcatcggcgttgccttccgccagtactttaccgctggcgtaatccattaagatccaggctcgcgcatcaacgcccggcggcgcgatcgtttgttcctctgcctttacaggcgaagcgaaaaggaataagagaaccgaacctgccgcgaggctacgaagggaagaagcgtattgcgtcatagtaccacccgagtatccattccaaaaacacacgtcacaccaccgtgtaataagtgcggtgagtaataacgcactcacgacgttaaagaaaccgtaacttggtaaagtttttaaagtttatgcaataacatcccgttacgcttccttcataacgatttttttacagaccattgtgtaaatgttaggtttatctcacggtaggccgattactgtcatcatcctgataaaacagaaggggttaatatgattacgctgtggggccggaacaactcgactaatgttaaaaaagtgttgtggacgcttgaagagctggaactgccatacgatcaaattctggcaggtggaaaattcggcgttaaccaggatgccgactatctggcgatgaatcctaatgggctggtgccgctgcttaaagatgatgaaaccgacctgttattgtgggaatccaatgccattgtccgctatctggcggcgcaatacggccagaaccggctatgggttgataatccggcacggcgtgcggagggcgaaaaatggatggactgggcgaatcaaacgttaagcccggcgcaccgcgtgatcctgatgggactggtcagaaccccgccggaaaaacgcgaccaggcggcaattgaagccggtatcgaaaagtgtgatagcctgtttgcgcttcttgatgatgcgctggcccaccagccgtggttctcaggggataactttggcaccggcgatatcgctattgcgcccttcgtctataacctgctgaacgtgggtctgaagtggacgccgcgcccgaatctgcaacgctggtatcaacagcttaccgagcgccctgcttttcgcaaagtggtgatgatcccggtgacctaacgcgtggctgcaggacttaccttgagtaactgcccgtcggactcatcggttaacacatataagtagccgtcaggtccgacacgcacatcccgaatacgctgctttctgtcacccagaatacggccttcttccgtcaccgtattgccatcgacgcgcatcacaatgacctctttatcttttagcgcgccgataaacagtttgtgccgccacggcgcaaaaacgtcgctggcataaaaagccatcccgctgatcgccggagaatccttccagtagtaaaccggttgctccgttccctcgacaatttcacctttggcttccggcactttcagaccactatagttgacgccccatgtggccagcggccagccataatttttgcctttttccgggatgttaatttcatcgccgccgcgcggaccgtgttcatgcagccatagcgcgccgctccagggattgatggccagcccctgcggattacgaataccgtaagaccagatttccggacgcgcgcccgcctgatgtacaaacggattatccggcggaatttcgccctgcccggtcaggcgcaccagcttaccctgtaatttatccaaatcctgcgcggtagcgcgctggttattttcacccagggcaataaaaagaaacccttgcgcatcgaataccatacgtccgccgaaatggttgccggtagacagcttaggcatctggcgaaacacggtacgaaaatgctccagacgctgaaaatcgtcgctcagccgtccaaagccggctgccgtaccggcgtttccttcgcggtcagcttcagcatagctcagccagacgcggcgcgactgggcaaaatcaggcgccagcacgacgtccagcaaacctccctgcccgtttgcccacactttcggtacgccagccagcggatcggaaagtccccgccccgtctgccagtggcgcagttgtccccctttcagggtaatgagcatcccacggttatccggcaaaaaagccagcgaccacgggtgatcgagtcgggtttgcagcacctcaacgttcaccggcgcaagattggcgttcgcccatgaagagaaaagagagaatgaaactatcgcgagaagtattcgacgcataccgcctccttcagggctctgcgttaaagcgtagtcagcatcgcaagaggtcgggtttatttttacaaaacattaagcggcgcggtccggtaaaaagggggagtcgcctcccccttattcagacctgtgtaagcggtgaatgtgctttcagactctgaatactcagcgtcaaagttgtcagacagttttcaagtttatctgcgttgacggcaataaaggtcggacaatcatggtgtccactcattaaacaaacggcggcggctgcaagcgcgccttcggcacggcgcagcgcgttccactcttcctgatcgagatgcagtccctgccgtaaagcgtgatcgtggagctcgcgattcagttcaaaaaaattgtcacgcagagtgtcactttcgctgactgacatataccccttcgcttttcgcaattgcagataagcggcaagatcgatacgcgcgtttatcagcttgttgagaagatcggttctcagtctgtcaacgaccataccttttttcctcctcttttctaccagggttcaacttaatagtatggtcgttttttagacaaaggggtgtcagagatcaagaattttcttagaattgccctttttcaccttttgctgataaccacaacggttgatgccgccgctcctgatgagattgcgatacaatttttgttcggatatctgtagaatccctgccctgaccattccaataaatgaacactttttaagctatgagtaatgtaacccaccagccaaagatcggcttcgtttccctgggctgtccgaaaaacctcgttgattcggaacgaatcctgactgagctgcgtaccgaaggctatgacgttgtgccacactatgacgatgcggatatggttatcgttaatacctgtggctttattgacagcgcggtacaagagtcactggaagccattggcgaagcgctgaacgaaaacggtaaggtaatcgtcaccggctgcctgggcgcaaaagaagatcagatccgcgaagtgcatccgaaagtactggaaatcaccgggccgcatagctatgagcaagttctgcagcacgtacatcattacgtaccgaagccgaagcacaatccatttttaagcctcgtaccggaacagggtgtaaaactgacgccgcgccattatgcgtatctgaaaatttctgaaggctgtaatcaccgctgcacgttctgcatcatcccgtcgatgcgcggggatctggtcagccgtccgattggcgacgtattaagcgaagcgaaacgtctggttgatgccggggtcaaagagattctggtgatttcgcaagatacctccgcctacggcgtagatgtgaagcaccgcaccggattccataatggcgaaccgatgaaaaccagtatggtgagcctgtgcgagcagttatcaaaactgggcgtctggacacgtctgcactacgtctacccctacccacacgttgatgatgtgattccgctaatggcggaaggcaaaatcctgccttatctggacattccgctgcaacatgccagcccgcggattcttaaactgatgaaacgtcctggttccgttgaccgccagctggcgcgcattaagcagtggcgcgaaatctgcccggaactgaccctacgctccacctttattgtcggcttccccggcgaaacggaagaagacttccagatgctgctcgacttcctgaaagaggcgcgcctcgatcgtgtaggctgcttcaagtacagcccggtggaaggcgcaggcgcgaatgagctgccggatcaggtgccggaagaggtgaaagaagagcgctggaaccgctttatgcaactgcaacagcaaatctccgctgagcgcttgcaggaaaaagtgggccgcgaaattctggtgatcgtcgatgaggttgacgaagaaggcgctatcgggcgtagcatggcggatgcgccggaaattgacggcgcggtctatttgaacggcgaaaccaacgtcaagccgggcgatatcgtgcgcgtgaaagtggaaaacgccgacgaatatgatttgtggggcagtcgggtttaacgccacttcccccggcgcgggtgccgaatgtgttaccccacctggcgagccggttccaggcccgccaggcgtcaacgccaccgggctggcttaccccttaatcttcgggtccagcgcatcgcgcaacccgtcgcctaacagattaaacgccagcacagtcaggaaaatcgccaccgccgggaagagcgccacgtgcggcgcgatgaccatatccgcccgcgcttcattaagcatcgctccccactccggcgttggcggctgcgcgcctaacccgagaaatgacaggcttgccgcggaaataattgacgtaccgatacgcatcgtaaagaaaaccacaattgacgagaccgttcccggcaagatgtggctaaacaaaatcgtcgtgtcgctggcgccgatactgcgggcagactcaataaacgtctgctgttttaagaccagggtatttccgcgcaccagacgagcaaacgccggaatagagaaaatcgccaccgcaacgatcacattagcaataccgctgcctaacaccgccacaacggcaatcgccagcaaaatgccggggaaggcgaacaacacatcgcaaatgcgcataatgaaacgatcccaccagccttcataatatcccgccagcaatcccaacaccgtgccgattatcgcgccgataaataccgcgaacacgcccgccgccagtgagatctgcgcgccaacgagaacccggctaaagatgtctcttcccagcgagtcaacgccaaaccaatgctgcaaagaggggccattgttcaggctatcgtagtcaaaatagttttccgcatcgtagggcgttagccaacgggcaaaaatcgccaccagaattaacgccagtacgaatcccccggcgaccaacgcgacatgctggcggcgaaaacgacgccagaactcccgccacggcgtgcgtatctggtcgggttttaccaccggcatagcatgtaaaatcgcctgacggcgccagttaaataatcgcatccttacttatacctgatagccggattaatggcggcatagaggacatccaccactaagttgataagaataaattccagagaaaacagcagcacttctgcctgaatcacggggtagtcgcgcatgtcgacggagtcgaccagtaatcgcccaagccccggccagttaaacactttttcgacgacgatcgatccgccaagcagaaagccaaattgcagtcccatcatggtgacgaccgggatcattgcattgcgcaggccatgttttaacaccacccacgtttcactgacgcctttcgcccgcgcggtcctcatgtaatcctcgctcagcacatcgacaaacgaggagcgcgtaaaacgcgccatgactgatgccaccgccgcgccaagcgtcagggagggtaaaatataatgttgccagctatccgcccccacggtcggtagccagcccagatccacggaaaaaatctgcattaacaacattcccagcgcaaaagccgggaaagaaatgccggtcacggcaagcgtcattcctacccggtcaggccagcgattacgccacacggcggcggcgatgccgatcgccatgccaaacaacaccgcccatatcatactggttatcgtcagccacagcgtcggcaaaaagcggctggcgatctcctcagaaaccgggcggcgggaaaccattgacgtcccgaaatcgccttgtaaaacatgggtgatgtaatgccaaaactggacatgaagcggctgatcaagccccagctgctgacgaaccagcgctatcacctgcgcgtcggcttccggtccggctatcagccgcgccgggtcgccgggcaacaaatgaacaaataaaaacaccagcactgccacaatcaacagcgtaggaattaatcccagcaggcgcttgagaacatagttaagcatcacacgaaccttttaccggatggcggacaacgcgcgcgccatccagccccatcgcattacttacttcaaatccgcatcgtcaaagctgaaaccggtatccggcataatccagaaaccggtcaaatttttactgtgcgcagaaaccaatttctccaccaccaacggtatccagggcgactctttccagataatatcctgcgcctctttgtataatcgtgttttctcctgcggatcgttagtctttaaggccgccgccaaatcgctgtcgacctgcttgttgctgtaaaaagcggtattaaactgcgtcggcggccagttttgtgatgcgaagagcggcgataacgcccagtcagcttcgcccgtcgacgccgaccagccggtatagaacattcgcacgccgctctctttttgccctttgccctcaacttccgcggcgcgctggccggcgtccatcgcggttatccgggctttaatgccaatctgcgccagttgctgttgggtaaactgcaacactttttgcgcggtgctatggttgtgcgatgaccacagcgtggtactgaaaccgtctggataccccgcctctttcaatagttcgcgcgctttagccggatcatagggccacggctgatagctttgcgcataggctatcgacggcggcaccacgcccgtcgccggcgtggcgtatccggcaaacgccactttaaccagcgcctgacgattgatagcgtaattcaacgcctcacgcaccttaggattatcaaacggcttctgcgtcacattcatactgatataacgctgcataatggacgggctggcgaccagttcgaggtttttatttttcgccagtaacgcggcctgctcataagggataggaaaagcaaattgcgcttcgccggtttgcagcatcgccgcgcgggtattgttgtcagtaaccggacgccaggtaatagaatccagcttgggtaagccctgctgccagtaaccggcgaactttttcactttgacaaagtcggtctgattccaggtttcaagctgatatggaccagtgccgaccggatgaaaaccaatatccttgccatatttttccagcgcttgcggcgagatcatcgccgtcgccgggtgcgccagaatattaatgaaagcggagaacggctgtttcagggtaatttttaccgttgccggatcgacgacctccgtttttgcgatatttttatacaggttataacgcttgaggtggttatccggattgctggcgcgatcgagattcgcttttaccgccgccgcattaaaatccgcgccgtcctgaaatttcaccccctgccgtagggtaatggtgtaggtcagaccgtcatcagaaacggtatagccttccgccaggacgttttttaccttcatgtctttatccaggccaaacagaccttgataaaatgacttcgccaccgcctgcgagagcgtatcgttggcgtcatacggatcgagcgtggtgaaattagaccctaccgccaccaccacatctttggccgccagggccggaaaagccgcaatggatgaggccagtcccagcgccgccagccatttatgcgtaataaattgcgtcatgttgttctcctgaaaccctgcctgtctgaatgttataagcgcgagagcgcattatcctgcagcggccgcgcaacataatgtcccggcccgaccaactgtaatgaaacggcgggcgtctcttcgccacgtttatgaatattgctgggtatatcatctgatagcagaacgcgccgcggccggtgtctggagggatcggcaaccggcaccgccgccatcaatttacgcgtataaggatgctgcggattttcaaaaacggcgcgccgcggccccatctcaacaatttgaccaagatacatcaccgccacgcgatggctaattcgctccacgaccgccatatcatgcgaaataaacaggtaggcgatccccatttcccgttgtaaatcgagcagtaaattaatgatctgtccgcgaacggaaacatccagcgcggagaccgcctcatcagcaataatcactttaggattcaatgccagcgcgcgagcaatgcagatgcgctgacgttgaccgccggaaaactcgtgcggataacgccaggcatgttcaggacgtaatccgacacgctcaagcaaccaggccacgcgctttgccgcagcgtccccctgccccagaccatgaatccgtaaaggttccataatggaataccccacggtctggcgcgggtcgagcgaggcgtaagggtcctggaaaatacactgaatatcgcggcgcaacggctggagtttacccgcagacagcgtgtcaatgcgctggccgttaaagataatctccccctgccgggattcaaccaaccgcagcagcgcgcgtccggtcgtcgattttccgctaccggactcgcccaccagcgatagcgtttcgccgggccagagatcgaaactgatattctcaacggcatgaacttcacgcgtaacgcggttaaagagaccgctacgcagcgggaatcgcgtcaccagcccccgaacctggagaataggttcgccttccaccaccgtgtcttgctcaatctgcgattcataaagggccggttcgtcagcggaaatcaacgggaaacggcgtggcagcgagtggcctcgcatcgcgccaagctgagggacggcggccagtaacgtttgggtataaggatgcgtcggcgcatggaaaatctgctctacgctgccggtttccacggcctcgccctgatacatcaccagcacgcgatcggcaatatccgccacgacgcccatgtcgtgagtgataaaaatcacgcccatcgacatctcttgctgcaacactttgataagttgcagaatttgcgcctggatagtgacatccagcgccgtggtgggttcatcggcaatcaataccgccggacggcaggatagcgccatcgcaatcatgactcgctggcgcatcccgccggaaagctgatgcggataacgcgataaaatcgcctgcgactccgggatccgtacctgatcgagcatacgtttcgcttccgccagcgcctcttcgtggctggccccctgatgcaaacgaatagattcggcaatttgctcgccaacggtaaataccgggttgagcgaggtcattggctcctggaaaatcatggcgatatccgcgccgcgcacacgccgcatctgcgcgtcactctgctcagacagctcaatcacctggcgattacgccgacgcaacagcatttcgccgcagcgcacgttcgcgcccgactgctcaatcagccgcattaacgccagcgccgtcaccgattttcccgagcccgactcgccgacaatcgtcagagtctctccacgcttcaggcgtaatgacacattacgcacggcgtctacctgttgcccttcgtggtgaaacgcgatattcaggccactgacggacagaacatcgcggctatccagttcatcgctgtgcggcacctgcggctccttattcccggtaaattcctgtggtaggcgtatccccggcatatccccaggcgcgatacatcccttcgctgttaaacggcaacgcgacattaccttcgtgatcaacggcgattaatccaccgctgccgcccagcgccggtaatttttccatcaccacgcgctcacaggcgtcggcaaggctgagtccgccatattccatcaatgcggcgatatcgtaagccgcgagcgtgcgaataaagacctctcccgttccggtacaggaaacggcgacgctggcgttgttggcataacacccggcgccgaccagcgggctgtcgccgacgcgcccgggcaatttattggtcatcccgccggtagacgttgccgccgccagattgccgaatttatcccgcgccaccgcgccgactgtacccatttttttcgtttcgtccagcggcgcgccgctgtgatcgagcgccatttcgcccgccgcacgcgccgccagcaattgctcgtaacgcgccggggtggaaaagatatccggcgaaacgcgcgccatcccctgtgaaaaggcaaagttttccgccccttcccccaccatgagtacatgcgggctgcgctccatcaccagtctggcggcgagcacaggatggcgaacatgactcacgcccgcgacggctccggctttcagggtattgccgtccatcacgcaggcatccagttcatgagttccgtctcgggtatagaccgcgccgatacccgcattgaagagcggacacgcttccagcaggcgcaccgcttccgtcactacatcaagcgcgctgtcacccgcttccagcatcttttgcccgctttcgacaatctctgacagcgcctggatatagcgtagctcctgctcatggctcatttgcgcgcgagcaatcgcgcctgcgccgccgtgaatcgcaatcactgctttattcatttttagggtccattaacggtggcacacaacttttactataactatcagaattgttgtgagttattcattcgatttttgaatatagaaagatgcgtaaggtatgtaaaggcgcaaggccgtctctaagactgaggtagcatactgcccgccactgttttctgacataatagccggattcgattttgcctcgcaggagtatgttcatggaattttccgccggattgatgccgcttgaaacggcgctgacccagatgctttcacgtattaccccgctcaccgccgtagaaacgttgccgctgatgaactgctttggccgcatcctggcgaccgatatcgtatctccccttgatgtccccggctttgataattcagctatggatggttatgcggtacgtgtggcggatttgtccgccgataagccgctgcccgtcgccggcaaagcatttgccggtcagccttaccaaggagaatggcctgcgggaacctgtattcgcattatgaccggcgccccggtgccggcaggttgcgaggcggtcgtcatgcaagagcagacggaacaaactgatgacggcgtgcgttttaccaccgatgttcgttgcggacaaaacatccgccgccgcggcgaggatattcgccaggatgcggtggtctttccagccggtacgcgcctgactactgccgaactgccggtgctggcgtcgctgggaattgccgatgcgcaggtagtacgtaaagtgcgcgtagcgctgttctcgaccggcgacgagctccagcttccgggccagctgctggaggcgggacaaatttatgacactaaccgtctaactatacatttgatgctgcaacagcttggctgcgaagtgatcaatttaggcattattcctgacgatcccggtaagcttcgcgccgcgtttgtcgacgccgacagccaggccgatgtagtgataagctccggcggcgtctcggttggtgaagcggactataccaaaaccatccttgaggagctgggcgaaatcgccttctggaagctggctatcaagccaggcaaaccgtttgccttcggcaagctcagtaatagctggttctgtggcctgccggggaatccagtctctgcggcgctcacgttttatcaactggttcagcccttactggcgaagcttggcggcaatacggcaagcgctgtaccgccgcgccagcgtgtacgcacaacatctcgcctgaagaaaacgccggggcgtctcgatttccagcgcggcatcctgcaacgtagcgccaacggcgaactggaggtcacgaccaccggacaccagggctcacatattttcagctcgtttaatctgggcaactgctttattgtgctggagcgtgaacgcggcaatgttgagccgggagaatgggtggaagtcgagccgtttaatgctctgttcggaggcctgtaatggcggaacttagcgaccaggagatgctgcgctataaccgacaaattattctgcgcggcttcgattttgaagggcaggaagcgttaaaagatgcgcgggtattagtggtcgggctgggcggactcggctgcgcggcaacgcagtatctggccggcgctggcgtcgggcaactgacgctactcgattttgataccgtttccgtttccaatctccagcgtcaaaccttgcacagcgacgccacggtcgggcagccaaaggtagagtccgcccgcgacgcgctggcgcgaatcaacccgcatattaccattacgcccgttaacgcgcggctggacgacgacgctatgaccagcctgattgccgggcattcgctggtgctggactgtaccgataacgttagcgtacgtaatcaacttaacgccgggtgctatatcgcgaaagtgccgctaatctccggcgcggccattcgtatggaaggacaagttaccgtctttacgtatcgggaaaacgaaccctgttaccgctgcctgagccgtctgtttggcgaaaacgctctgacctgcgtagaagctggggtgatggcgccgctgattggcgtgatcggttcgctacaggcaatggaggccattaagctactggcgcattacggtcagcctgccagcggaaaaatcgtcatgtacgatgcgatgacctgtcagttccgcgaaatgaagttgatgcgcaaccccggctgtgaggtctgcgggcagtagtcactttacggataaacataccaaagcacggtctatggccgtgctgtatcaacagataattactgccatcagacgcaaagccagcttacccaagctccgactgacgatcggctcaagcagcgcggcatcatcttaaacgccatatcacagcctcaacccgtgatgttgtacctcatttaacgcctctttgtcagaacctctccattcgttgacgcacatcaagataactttcattcgaaagtaatttaatctttacatgaaataagagaggccgtttatgatcttcaatattcagcgctattccacccacgatggccccggtatccgtaccgtagtatttctcaaaggctgttcgttgggctgtcgctggtgccagaacccggaaagccgcgcccgcgctcaggatctgttatacgacgcgcggctgtgtctcgaaggatgcgacctgtgcgcgcaagccgcgccggacgtcattgagcgcgcgctaaacggcctgctcatccatcgcgagaaactgaccgacgcccatttttccatcctggcgcattgctgccccacacaggcgttaaccgtgtgcggcgaaataaaaagcgtggatgagatcatggcgacggtactgcgcgataaacctttttacgatcgcagcggcggcggtcttacgctttccggcggcgaaccgtttatgcagccggagctggcggcagagctgtttaaagccagccatgacgccggtattcatacagcggttgagacctgtctgcatgtcccatggaaatacattgcgccctcactgccttatatcgatctgtttctggctgatttgaaacacgtcgccgacgggccgtttaagcagtggaccgatggcagcgcctcgcgggtgctggaaaatctcaggaaactcgccgccgcgggcaaaaaaatggtgattcgcgtcccgctgattcagggatttaatgccgatgaggagaccattaaagccattaccgactttgccgccgacgaactgcacgtcggggaaattcattttctgccctaccacacgctgggcatcaataaataccacttactcagtcagccctatcatgccccggataaaccactggatgcaccggcgttacttgattttgcccagaagtacgcctgccaaaaaggtttaaccgcgaccctacgaggataattatcatgacccaactgaaactggacacgctcagtgaccgcattaaggcgcacaaaaccgcgctggtacatatcgtgaaaccgccggtctgtaccgagcgcgcgcagcattataccgaaatgtatcagcaacatctggataaaccgattccggtacgccgcgcgctggcgctggcccatcacctggcggaacgcactatctggataaaacacgatgaactgatcgtcggcaaccaggcaagtgaagtccgcgccgcgccgattttcccggaatataccgtctcgtggattgaaaaagagatcgacgacctggcagaccggcccggcgcaggtttttccgtaagtgaagaaaacaaacgtattctgcacgacgtctgtccgtggtggcgcggtcaaaccgtccaggatcgctgctacggcatgtttaccgatgaacaaaaagggcttctggcgactggcattatcaaagccgaaggtaatatgacttccggtgacgcgcacctggcggtgaacttcccgctgctgctggaaaaagggcttgatgacctgcgcgataaagtcgccgagcgccgctcacgcatcaacctgaccgtgctggaagatctgcatggcgagcagttcctgaaggcgattgatattgtgctggacgcggtaagccagcatatcacgcgctttgccgcgctggcgcgccagatggcgggcgaagagtcccgtgaaagccgtcgtaaagagctacttaccatcgcggaaaactgcgaggtgatcgcccaccaaccgccgcagaccttctggcaagcactgcaattgtgctacttcatccaactgattctacaaattgagtctaacggtcactcggtgtcatttggtcgtatggaccagtatctttacccctattatcgtcgcgatgtcgaactaaaccagacgctggatcgtgagcacgccattgaactgctgcacagctgctggctgaaactgctggaagtaaacaagatccgctccggttcgcactctaaagcttccgcgggcagcccgctgtatcaaaacgtcaccattggcggtcagaatcttatcaacggtcagccaatggacgcagtgaatccgctgtcttacgctattctggagtcctgcggacgtttgcgttctacccagcccaacctcagtgtgcgttatcacgccggaatgagtaacgatttccttgacgcctgcgtccaggtcatccgctgcggctttgggatgccggcgtttaacaatgatgaaatcgtcatcccggaatttatcaagttggggatcgaaccacaggacgcttacgattacgcggcgatcggctgtatcgaaaccgccgtcggcgggaaatggggttatcgctgcaccggcatgagctttattaacttcgcccgcgtcatgctggcggcgctggaaggcggtcgcgacgccaccagcggcaaggtatttctgccgcaggaaaaggcgctctccgcaggcaactttaacaattttgacgaagtgatggccgcctgggatacccaaattcgctactacacgcgcaaatcgatcgaaattgagtatgtggtcgacaccatgctggaagagaacgtccacgatattctgtgctcagcgctggtagacgactgtattgaacgcgcgaagagtatcaagcaaggcggcgcaaaatatgactgggtatccggtctgcaggtcggtatcgccaacctgggcaacagcctcgccgccgtgaaaaaactggtcttcgaacagggcgttatcggtcaacagcagcttgccgccgcgctggccgatgactttgacgggctgccccatgagcagctgcgccagcgtctgattaacggcgcgccgaaatacggtaacgacgatgacagtgtcgataccctgctggcgcgcgcttatcagacctatattgatgagctgaagcaataccataacccgcgctatggtcgtggccctgtgggcggcaactattacgccggtacgtcctctatctcagcaaacgtgccatttggcgccgcaactatggctaccccggatggtcgcaaagcgcatacaccgctggcggaaggcgcaagccctgcatcgggtacggatcatctcggcccgacggcggtgattggttccgtaggcaaattacctaccggttccattctcggcggcgtgctgctcaatcagaaactgaacccaacgacgctggaaaacgaatccgacaaacagaaactgatggttctgctacggacgttctttgaggtgcataaaggctggcatattcagtacaacatcgtgtcacgcgaaacgctgctggatgcgaaaaaacatccggaccagtaccgcgatctggtcgtgcgtgtggcaggctactccgccttcttcaccgcgctgtcgccggacgcgcaggacgatatcatcgcccgtaccgaacatatgctgtaatttgcccaggcgccatcggcaatatgtccgaactgcctgatggcgctacgcttaacaggcctacgcaggcctgttaatcagaagggatcggtgccgtcaagcacggcctgaatgacgttgagcgcgccttgatggttattatcatcagtgtgataacgtgaaagcgctttgatattgtctgcggcattgcccatggcaaaagagtaatgcgccattttcaacatttccgcatcattaccgctgtcgccaatggcgacgacattctgtggcgacctgttccagcgctttaacagacgactgatgccattcgctttatgcagtcccgggataatcaggtcgataaaaccgaagccgctggtgacaggcttcatgatgccatccagagatacgtgcagtttgtcgataaccagcggaatttgttcatcgggcaaattcagggagaacttaaacaggatatcgtcaatgtcgtgataatcgtttaccggctgcaggcggtgataatgtttggccatcagcgccacgaaagtctcgggagcgtttttgctgacataagcgcttttcagaccgcaggcgacgaagttaagctgcttatccttcagcagttcgccaatcacaatacgcgattcatgccgggttagctctccgtgaaacaactgcttgccatgttcatacaccagcgcgccattttctgcgacgaaggaaatttcgtctttcagctcggggaagaaggagatcaactgatagtactgattaccgctggcgaccacaaattcgatattacgttttttcagttcctggtattgcgccatgaagcgtacacgatcgtactgcttggcatcgtcgagaaaagtgccgtccatatcggtaacgacaacgttaacggtcatacttaagctcctggctgtaactgcgaccagaaacattttaataacaatgtgagcagaaccacaaatttatttcgaatgaaaagtggctgaacgaaaggaatagccgcataagacattaaggcgtcctggccaccttacgttttcctctcgcttccctccttgtgcgcccctgcaatattttaaacttgcattaaccttattttaacttaaagtatcacatgtaactaattttactttcgaacgaaagatggtgaggttgatatgacgactccttttacctacgaaacgctgcccgccgacccaaaagcggccattcgtcagatgaagcaggcgctacgcgcgcaaatcggcgacgtacaggcggtgttcgaccgtttgagcgccaccatagcagcccgggtggcggaaattaacgatctgaaggcgcagggacagccggtatggccaattatcccttttagcgaactggcgacgggcaacattagcgatgctacccgcgccgaggttaagcgccgcgggtgcgcggtgattaaaggtcattttccacgcgaacaggcgctggcatgggaccagtcgatgctcgactatctggacaagaaccattttgacgaggtgtataaaggaccgggggataattttttcggtacgctgagcgcctcccggcctgaaatctatcctgtctactggtcgcaggcgcaaatgcaggcccgccaaagtgaagagatggcgctggcgcagtcgttcctcaaccgtctgtggcaggtagagcgcgacggcaagcgatggtttaatccggatatcagcatcatttacccggatcgcatccgtcgccgcccgccgggcaccacatccaaaggactgggagcgcataccgactccggcgcgctggagcgctggctgctaccagcctatcagcaggtattcgccagcgtgtttaacggcaacgtcgagcagtacgatccgtggaatgcggcgcaccgtaccgaagttgaagagtacacggtggataacaccacaaaatgctcggtatttcgcaccttccagggctggaccgcgctctccgatatgctgcccggtcaggggttgcttcatgtcgtccctattccggaggcgatggcgtatattctgctgcgcccgctgctggatgatgtcccggaagatgaattatgcggcgtcgcgccgggccgggtgctgccgatttctgaacagtggcatcctttactgatggcggcgttaaccagcattccgccgctggaagccggggattccgtgtggtggcattgcgatgtcatccactccgtcgcccccgtcgaaaatcagcagggctggggcaatgtgatgtacattcctgccgcgccaatgtgtgagaaaaatctggcctatgcgcgtaaggtgaaagcggcgctggagacaggcgcatcaccggacgatttcccgcgcgaggactatgaaaccacctgggaagggcgtttcacgctgcgcgatctgaatattcacggcaagcgggcattaggtatggacgtttgacggtcgtacagccctgcccgctcaactgcggtgtgccctttgtctgggcgcacccgtcttaccagatctacgcgccaggatacgtaggcccggtaagcacagcgccaccgggcgtcagtgtttagctttcaatccctttactacgcaaataatcgtcgtagttaccgctgaagtccaccacgcgctccggcgtaatttcaatgacgcgggttgccagcgagctgacgaactcacggtcgtgcgaaacaaagatcagcgtgccctgatacagctccagcgccatattcagcgattcgatcgactccatatccaggtggttagtcggttcgtccatgatcaggatattcggcttttgcatcatcagtttgccgaacagcatacggcccttctcgccaccggagaggactttcgcaggctttttgatatcatcctggctaaataacaggcggcccagaatactgcgcactgcctgctcgtcgtcgccttcctgtttccactgactcatccattcaaacaccgtcaggtcattttcgaattcatattcgtggtcctgcgcgtagtaaccaatacgcgcgttttccgaccatttaacggtgccgtgatcggcgtccagatcgccaaccagcgtcttcagcagcgtagatttacccacgccattggtgccgagtaccgccagcttctcgccgacttcgagcagcaaattgacatttttaaacagcggaccgttatcaaaacctttcgtcagcgcctccacttccagagcgttacggaacagttttttatcctgctcaaaacggatgaacgggttctgacggctggaggctttcacctcttccagcttgattttatcaatctgccgcgcgcgcgacgttgcctgacgcgatttagaggcattggcgctaaaacggctaacaaaagattgcagctcggcaatttgcgcttttttcttcgcattatcggccaacagacgttcacgcgcctgggtcgccgccgtcatatactcatcatagttacccggatagacgcgcaagtcaccgtaatccagatccgccatatgcgtacaaaccatgttcaggaagtgacggtcgtgcgaaatgatgatcatcgtgctatcgcgctcgttcagcacctgctccagccaacggatagtatcaatatccaggttgttggtcggttcgtcgagcaacaggatgtccggattagagaataacgcctgcgccagtagcacacgcaatttccagcctggcgcgacttcactcatcagaccgtaatgctgctccagcgggatgcccacccccaacagcagttcgcccgcacgcgcctcagcggaataaccgtccatctcgccgtattttacttccagatcggcgactttatagccgtcttcttcgctcatttccggcaaggcatagatacggtcgcgctcctgcttgacttcccacagttcgccatgccccataatgacagtatcaagtacggtgaatgtttcaaaagcgaactggtcctgacgcagcttaccgatgcgctcattcggatcgagggaaacattgcccagcgtcggctccaggtcgccgccgaggattttcataaaagtggactttccgctaccgttggcgccgatcaggccgtaacggttgccgccgccaaatttgacggaaatattttcgaacagcggcttactgccgaactgcatggtaacgttgctggaaactaacacaggcttatcctgaaaaaagatgtgacaaaccgcttattatgccacaagtctgaaataagatcgcgccctatacaaagggctacactgaaccgtaaggggaaaaaaacgtgatttcgtacacatctgaattccctgtttactggaatgcacctataatgcgctcccaacatgacagaattctcaacctactagcctgcttggcacagaatctcgcataacatgaatatgaaattaacaacgcttttcgcggcggctttcgctgtagttggtttttgtaaaacagcctcagcagtcacttacccgctgcctaccgatggtagccgtttaattgggcaaaatcaggtcatcaccgttccggagggcaatacccagccgctggagtattttgccgcggagtatcagatggggctctccaacatgctggaagccaaccctggcgtggataccttcctgccgaagggcggtaccgtgctgaatattccgcagcagctgatcctgccggataccgtacacgaaggcattatcatcaatagcgcggaaatgcgcctctattactacccgaaaggcacaaacaccgttatcgtcctgccgattgggatcggtcagttaggtaaagacacgcctatcaactggacgaccaaagttgaacgtaaaaaagccggtccgacctggacgcctacggcaaaaatgcacgctgaatatcgcgccgccggcgagccgctgcctgccgtcgtgcctgcgggcccggataacccgatgggcctgtacgcgctgtacatcggtcgcctgtatgctattcacggcaccaacgccaacttcggcatcgggcttcgcgtgagccacggctgcgtacgtctgcgcaacgacgatatcaaattcctgtttgaaaatgtgccggtcggtacccgcgtgcagtttatcgatgaaccggtaaaagccaccaccgagccggacggtagccgttacattgaggtgcataacccgctgtcaacgacggaagcgcagtttgaaggtaaggaagcggtgccgatcacgcttaataagagtatcctggccgtcaccaacgagcctgacgttgatcagaccgtcgtacaacaggcagttcaggatcgttccgggatgccggttcgtctgaactgacagactctgcctgcgaagcccgatagacactatcgggcttctcttacggcatcagttgcaataatccatatcccaccagcgccgcccatgccagcatcggcagcgaatagaaatgaaatcgccaccagattcggcgatcgttcgccatccgtaaagcaataagatttgccagcgaccccggcagcagaccaaacccgccgatattcaccgcccacgccagcaacgtcgaggccggtacatagttcagcaggagaatggtactgggcacattactgataacctgcgacaggccgatagcggttagccaaagtcccaggtgagacagtgcgccaacttggttgaaaacgccctgcaacgccggcaattgcgttagcagatggacatcaataaacatcgccataaataccagcagcagcgtccagtccacgctgactatcaccctgcgcgccagcacaataaacccagccgccaccaacaccagtccccataactcttgcctgagctccagcgcggtaagaaaaacgacatataatgccaggcaactccacaccagacggggctgccactgcggcgaacgcgtaccggtatgatactgtaacgccctacccggaaaacaaaaccagcacaggagcagtaacgtcagcatcatcatgacggcaagcggcgccatttgcccgctaaattcagcaaagcttaagccggagcgtccccacaacagaatattttgcggattaccgacaggcgtcagcagcgaaccggcgttcaccgctaacgcttcaaaaataatcaatcggttgaccggaatcgcgcacagtttttttaacgttatcgtcagcggcacaacgataaacagcgcgacatcgtttgtcagaaaggtcgacagcgccgccgcagccagcaccaggaacatcgccagttgccgctcggtatgaaatcggcgcgtcatcttgcgtcccagcacatcaaaatagccgctcagctcaacgcctttagtgagcaacattaacccactgagggtaataatggtgtgccagtcaatcgcgccaggccaggcgcggggcgcaaaaggaacaaacaggcttaacgccatccccacaatgatcaacaactgaaaaaaacggtcacgccgcagcgcccgtaaaaaggccagattcattctgcagatgttccatgctgttgcgtgaaggccaaaaaggcatctaatgtctcttggctgacatggtgttccatcccttccgcatcacgacgcgcgatttccgggcttacgcctaataccagtaaaaaattttcgacaatttgatgccgctcgcggctttcctgcgccagcttctccccttccggcgtcagaaaaacgccgcgccaggggatcatttgaataaatcctaacgatgccaggcgcttaagcattttggccacagtcggctgggagacgccgagccgcgccgccatatccacctgacgcgcttcccctacctcaataattaaatcggaaatcagctcaacgtagtcgtctatcaactcacgccgatgcgcctctctgacctgacgaaatccttcaacgtgttcttctacgttcaccaattgcgtcactttttttgttgttggcgtacctgcgcgacgacccattttgcttcctcgtttctgtgacgcgttaacgcgtcagctgacagagcgctcattgtaaaccagagttgtccgggcacaaaaaattaacgttttagcaatagctataaaacatagcctgtgctatatctgtatgtaatgcagacatccctcacggatcgatgggatagaaacatcaggaggtttatatgaacgaatttaagaggtgtatacgcgtgttcagtcactctccctttaaagtccggttaatgctgctctctatgttgtgcgatatgatcaacggcaaaccggaacaggataacccttccacgaaataacgcggcggtgcggtacgccgctttattttgcatcctcaacggaaatggcgcccatttcccctgttttttttgtggttttgctattctcttcgcaaaacattttctttccggcggttggccttcttacccgcacgctctatcttctggcagccttgaatattttgcgactcgccgttgcgaacccaataccttttttacgcataatcaggcaggtaatgacccttcgcgccagggttagcacatggcgtttttgcaatagtggcatatgaattcaacccttatcgattcacttctggcccgtcgtcgggctgtaagcccatgggcgggcctctactttttacagtcgctgctgattaacctcgcgctcggctacccctttagcctgctttataccgcggcgtttacctgcctgttgctgctgctctggcgctacctgcctcgcggacaaaaagcgctgctcggcatctgttcgctggtagccgcttgctattttccctttggccaggcttacggcgcgccgaactttaatacgctgctggcgctgcactccaccaatatggaagagtcgagcgaaatcctgaccatcttcccgtggtatagctacctgaccggactttttatttttgcgctgggtattattgcgcttcgccgccgaaaagaagaggtcaggccgcgctggaatagcctcgacagcctgtgcctgctgattagcgtcgcggcatttttcgtcgcgccggtacaaaatctggcctggggcggcgtttttaaggttattgataccggctatccggtttttcgcttcgccaaagacgttatcgtcaataacaacgaagtcattgaagagcagcaccgtatggcgcagctatccggcataaaagatagctggacggttactgcggtgaaacccagatatcacatctatgtcgtggtgattggtgaaagcgcgcgacgggatgccatgggcgctttcggcggccactgggataatacccccttcgccagccatgtgaatggcgacttctttatggattacatcgccgccagcggctcaacgcaaaaatcgctcggtttaacgctcaatcgcgtggtggataacaaaccgcagtatcaggataacttcgtcacgctggctaaccgcgccggttttcagacatggtggttttccaatcaggggcaaatcggcgaatacgacacggccatcgccagtatcgccaaacgcgccgatgaagcgcatttcctgaaaaacggcgattttgaagcggataaaaatactcgcgacgacgcgctgttaaccatgacggcgcaggtattggcgacagaacgcacgcaaccgcagttgattgtgttgcatttaatgggatcgcatccccaggcctgcgaccgtactcatggaaaatacgcgacgtttgtccagtcgaaagagacgtcttgttatttatacaccatgacgcaaaccgacgatttgctccgtcagctctatactcagcttcgtcatagcggcgacagtttttcgctcgtctatttctccgatcacaggctggcgtttaaagagcgcggcaaagcggtacagtacctggcgcatgacgacaaattccagcaaaacttccaggtgccgtttatggtgctatccagcgacagtaaagcgcatcggatcattaaagctcgccgttccgcgaacgatttcctgagttttttctcgcaatggacaggaattagcgctaaagagatcaaaaatcgctatcgatttatttcggaacagaaagccgggcccgtttatatcaccaatttcaaattacagaaagtggactataaccatctgggcagcgatattttttcactaaaataatgcacgtttcaggcaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaaatccgccccgaaaggcggatttttcattttcaccgacgtgattagaagcggtaacctacgccagcaatccaggtgccaacgtcaacgctacgaatacggctctgctcgtaagagaagtccagagcaacattttccatcgggttgaattgcagaccagcgccataggagaagccataatcgctggtgtcatgtttgtaggttgggtaatcggtcgtctggaatttaccgtaacccacaccgactacaccgtagatgctcgcccaatcgttcagacggtaagccgggccggcagtgatgccgtagtactgacctttattgtaatcgcccgcaccgttagtacgatctttttcggtgtaggtgaaggaaccgattacacccagcgggttgtcgtcctgctcgtaacgatacttcaggttgaaaccgctcattttattcgctacgccctgcgcgtcgctctgagcgtaaccaccggtaacagtagaagtagcagctactgcagtacctgcggaaaaagccagaacagcggccagtgctgaaagacatgcaatttttttcataaccacctcaaatgtgcttcaagtaagtcctaagttttaaatatatcaaaaattaatgggaaactctttgcgattcacggtgtctaagggcgcctttcatgtaacagaacgtttccataacgcgctatcttattcaattaacatcatttttccggctgattgcaccaataatgcgcgtgtggcgcgatacattcatccagattattcctaaactaacagtctatttatccatcaatttaagttcattttatggaatcctggaaatttttttttcaacgaatcctcaaccgctccggggaatttccattacactgccacctttactcgtactgacattttttgacaggagaaaggatgccggggtcaacacgtaaactaccagtctggttgcccattttggttttgctcattgccatgtcctctattcagagtggcgcttcactggcaaaatcgttatttcctcttgttggcgcgccgggtgtaacggcgcttcgtctggcgttgggaacgcttatccttatcgcctttttcaaaccctggcgtttgcgttttgccaaagagcagcggctgcctttactgttttatggtctgtcgctgggcgggatgaactatctattctatctgtcgattcagacggtgccgttgggtattgcggtcgcgctggaatttaccggccctctggcggtcgcgctgttttcatcccggcgtccggtagattttatttgggtcgtactggctgtgcttggactctggttcctgctgccattaggacaagatatgtctcacgtcgatcttaccggggccgcgttagcgctcggcgctggcgcctgttgggctgtctatattcttaccggccagcgagcaggcgcggaacatggtccggccacggtggcggtaggctcgctgattaccgccatcattttcgtgccgattggcgcagttcaggctggcgatgcgctatggcactggtcgattcttcccttagggttagcggtcgctgtgctttctacggcgctgccttattcactggaaatgattgcgctgacgcgcctgccaactcgcaccttcggtacgctgatgagcatggaacccgtgctggccgccatttccgggatgatttttctgggcgaaacgcttacgggcatacaaatcctggccctgtgcgccatcattgccgcctcaatgggttctaccctaacgattcgccgcgaaccgcaaattaaacaagttgacgtaaaatagtttcttattctgcatgatgtgcataatcatgcagaatatcacctcgttattcaccttttattatcgcgctattacttcgtcattttttgtcatattttttctcattttttacattaaaatgagaattattacccatcaaacaacaaactcatctaaccaattgattcataaccaaaataaatattaaatcttgtctgtactattaaagtgataggtaaattcaaaaaagcgaagttaaaaaccggtgctatacttattttcgttaattacctgggacacaaacatcaagaggatatgagattatgagtaccgctaaactggtaaaaacaaaagcgtctaatctgctttatacccgtaacgatgtatcagagagcgataaaaaagcgacggttgagttgcttaatcgtcaggtgatccagttcattgacctgtcgctgatcacgaaacaggcccactggaacatgcgcggtgctaactttattgccgttcatgagatgctggatggcttccgtaccgcactgaccgatcatctggatactatggccgagcgcgccgtacagcttggcggtgtggcgttaggcaccacgcaagttatcaacagcaaaactccactgaaaagctatccgctcgacatccataacgtgcaggatcacttaaaagaactggccgatcgctacgctgttgtcgctaatgatgttcgcaaagctatcggtgaagccaaagatgaagacactgccgatatctttaccgccgcatcacgcgacctcgataaattcctgtggtttatcgaatccaacatcgaataaatctatctctaccctgaatacttcgagttgcaggaaggtacaaacgcagcgaatccgcaggagcctgacttccgtcggtcactgaagcgaacgcacctgcaacttgatgtacacaggtatataagtcatccctatacccctgcctggcacaggggttttgcacttaaatagtgcacatgtcttgtacttcccttcgataaaagtgaattatttgtaataattacatcacacaatcgttaattaaagattgttttaacaacaatttttacgctaaatagaccctgtatctctactttgttattcatgcactaaatcagtgccccaaaacagtgcagcatactggttttgcccgacttattgtgcacaggaatgattgacgcttctgttaaaacaatgagttacataattggcatgattttttcattacgctacatgttctcgcaggggatcgccccgtggatagaaaaggaaatgctatgaagtctctattaaaagtttcactggctgcacttaccctggcttttgcggtgtcttcgcacgctgcggataagaaactcgttgtggcaaccgatacggcgttcgttccgtttgaatttaaacagggcgacaaatacgtcggttttgatgttgatctgtgggacgctatcgcgaaagaactgaagctggactacaccctgaaaccgatggatttcagcggcattattccggcattacaaaccaaaaatatcgatctggcgctggcgggtattacgattacggacgagcgtaaaaaagcgatcgacttttccgatggctattacaaaagcggtctgctcgtgatggtgaaagccaacaataacgatattaaaagcgttaaagacctcgatggcaaagtcgttgccgtgaagagcggaaccgggtcggtggattacgcgaaagcgaatatcaaaaccaaagacctgcgtcagttcccgaacattgataacgcgtacatggaattaggcaccaaccgcgcagacgccgttctgcacgatacgccgaacatcctgtactttatcaaaaccgcaggcaacggccagttcaaggcggtaggcgaatcgctggaagcacagcaatacggagttgccttcccgaaaggcagcgatgaactgcgcgagaaagtcaacggcgcgctgaaaacgctgcgtgagaatggcacctataacgaaatctacaaaaaatggttcggtacagaacctaaataaaacgacctgatgttggcttgtggcccggtagtgaggacgctcaccgggcctacagctcttttccgtgacggataagacactttcacgccatttccgcgccggatagagcatttgactatttacaccacggtaacaggaacgacatatgcagtttgactggagcgccatctggcccgccattccgcttttgcttgagggcgctaaaatgaccctgtggatctcggtcctcggtctggctggcggcctggttattggactggcggcaggttttgcccgtacgtttggcggctggttcgctaaccacatcgccctggttttcattgaaattattcgcggcacgcctatcgttgtccaggtcatgtttatctactttgccctgccgatggcatttaatgatttgcgtattgatccgttcagcgcagcggtcgtgacaattatgattaactccggcgcttatatcgcggaaattactcgtggcgcagtactatccattcacaaaggttttcgcgaagcaggtctggcgctgggcctttctcgccgggaaaccatccgccatgttattttaccgcttgctctgcgccgtatgctgccgccgctgggcaaccagtggatcattagcatcaaagacacctcgttgtttattgttatcggcgtagccgagctgacccgtcagggccaggaaattattgccggtaactttcgcgccctggaaatctggagcgccgtggccgtcttctatttgatcattacgctggtgctgagctttattttgcgtcgtcttgaaagaaggatgaaaatcctgtgattgaatttaaaaacgtctccaagcactttggccccacccaggtgctgcataacattgatttaaacatccgtcagggcgaagtggttgtgattatcggcccttccggttcgggtaaatccacgttattacgctgtatcaataaactggaagagatcacctccggcgatctgattgtcgatggtctgaaagtcaacgatccgaaagtagacgaacggctgattcgccaggaagccggcatggtgtttcaacagttttatctgttcccgcatctgaccgcgctcgaaaacgtgatgttcggtcctctgcgcgtgcgcggcgtaaagaaagaagaagcggaaaaacaggcgaaagctctgttagcgaaagttggactggcggaacgggcgcaccactacccctccgagctttccggaggtcaacaacagcgcgtcgccattgcccgagcgctggccgtgaagccgaaaatgatgctctttgacgagccaacctccgctctggaccctgaactgcgccatgaagtgctgaaagtcatgcaggatctggcggaagaaggcatgaccatggtcattgtcactcacgaaatcggctttgccgaaaaagtcgcctcacggctgattttcatcgataaaggccgtattgccgaagatggcagtccgcaggcgttgatcgaaaacccgccaagcccacgtttacaggaatttttacagcacgtctcctgagatatcgcccttcctgccctgcggcaggaagggcatcatggaatagtcccatttcattttccctcccctgcgccatctatacttagtgttttgcgtctcttttctcactggaggagtcatgcggtggaccctgttcatccttttttgtctactgggcgcgcctgcccatgcggtcgccatacccggcgtgaccacggggacatcaaccagccagcaagcagcgccagagcccagtcctgaacaaaaaaaagcggcctatgcggccctggctgacgtactggagaacgaggcttcacgtaacgaattgatagcgcaactccgcgaagcctcaaccacgccgccgaccgagccagcgccagcgcttgccccgcctgcggccaaagatgagaaaacggtactggagaacgtcaccaccgttacccgtcagtacggcgatgctttcgctacccgtttcgcccagctttatcgcaacatcaccgatgcgccgtacaagccgtttaactcgcaaaccttcaccaacgcgttaacccactttttatttctggccgtcgcggtatttggtttttatagcgtgatacggctttgcgccctgccgttatatcgaaaaatgggcctgtgggcgcgcaagaaaaaccgtgaacgcagcaactggttacagctcccggcgatgatcgccggcgcgtttattatcgacctgctgctactggcgctcaccttatttatcggtcagatgctcagtgataatttccatgccggaagtcgaactatcgcttttcagcaaagcctgttcctgaatgccttcgcgctgatagagttctttaaagcgattctgcggcttattttttgccctaatgtaccggaattacgcccattcgcgattcaggatgcgacagcgcgttactggaatcgccgtatgagttcccttagcagtttgattggctacgggctgattgttgccgttccgattatttccaaccaggtgaatgttcaggtcggggcgatggcgaacgtggcgatcatgctctgcatcaccatctgggcgctgtacctgatctttaaaaacaaagcggagattacgcaacatttattaagtctggcggaacgatcattagccttttttagcctgtttatccgcgcctttgcgctggtgtggcactggctggccagcgcttactttatcgtgctgtttttcttctcgttattcgacccaggcaatagcctgaagtttatgatgggcgcgaccgtgcgcagtctggcgattattggcatcgccgcgtttatctccggtatgtttacccgctggatagcgaaaaccatcaccctgtcgccccatacgcagcgcaattacccggaattacaaaagcggcttaacggctggctctcctcggcgctaaaagtcgcacgctttttgaccgtctgcgtcgccgttatgctgttgctcaacgcctgggggctattcgatttctggcactggctacattatggcgcgggggaaaagatggtcgatatcctcatccgtatcgcgttaatcttattcttctccgccgtgggatggacgattctcgccagtctgattgagaatcgcctggcctccgatattcatagtcgcccgctacccagcgcccgcacgcgcacgctgctgacgctgttccgcaatgcgctggcagtgattatcagtaccataaccatcatgatcgtgttatcggaaatcggcgtcaatatcgcgccgttgctggctggcgcgggggcgttaggtctggctatctctttcggttcgcaaaccctggtgaaagatattattaccggcgtttttattcagtttgaaaacgggatgaataccggcgacttagtcaccataggcccgctgatggggacggtcgaaagaatgtcgattcgttccgtcggcgtgcggcaggataccggggcataccatattatcccgtggtcctcgatcaccactttcgccaactttgtgcgcggtatcggctctgttgtcgccaactatgacgtggatcgccatgaggatgcggataaagcgaatcaggcgctgaaagacgcggtaacggcgctgatggagacggaggatattcgcgggctgattatcggcgaacccacgttcgccggtattgtcggtttaacgaacacggcgtttactttacgcgtgtcgttcaccacgctaccgctcaagcagtggacggtgcgttttgcccttgatagccaggtgaaaaagcattttgatctggccaatgttcgcgcgccggtgcaaacgtatcaggttctgcccgcccccgccggcggcccgccgcctgattcactgccgccgcgcgaaccgacgatttagcgtttacgggtgataaaacggcgacgctggtcgtcatccataaaggtccaggcgataaagcggctttgcttttgctcctgggccatctcttttttcaccactttcaccgcgccagcctccgtcaacgcccggtaaagcggtggtaaattctcgccgcgcgacaccaacgtcgtaaaccacaacacctgacggcggaaggtttggctttcagcaatcatttttttaataaaggcgacttcgccgccttcgcaccatagctcctgctgttgaccgccaaagttcagcgcatcatctttattctgccccaaattgcggcgcttacgctcgctgcccgcgcgggctgcggcggcggagtcgtgaaaaggcgggttacaaagcgttgcgtcataaaattcatttttatgaataataccggtaaaaatggccgccggatctttttgccgacgcagacgaatggcgcggcttaaccccgtattagcctgaatgatagcctgcgcgctggacatcgctgcgtcgctgacttcactaccggtaaatcgccagccatattcatggacgccgataagcggataaatacaattggcgcccacgtccagaatagttgcctgcgccggaatactccctgttgtttcgccaagcagatccgccagatgatggatataatccgcacgaccaggcactggcggacataaaaaccctggcggaatgtcccagtgtgtaacggcataaaaatgcgccaacaacgccttattgagcgcttttaccgcttgcggattagcaaaatcaacgctctgttcaccggcgggcgtgcggataagataaggacgtcaattccggcgtggtctgacacagtgcggcgagatcataacggtgttgatggcggttgcgcgggtgtaaccccggtttctgggcggacatggcattctccttttagcagcggcgtaagatacccgtataacgccacggggtaaatataccaccgcgaattccctgcctcgctcgttttatcggctctctgaatgacattggctctgctcatggtctgaaaagatcgcgcgatgcgattttttcacctgacggcgctacacttaacctcaggtaccctaaaatcaggagagcgtgatggcatccggctgggcaaatgacgacgcagtgaatgaacaaatcaacaataccattgaagatgccgttgcccgcgctcgcggcgaacttccccacggcgaaagtcgcgatgaatgcgaatcttgcggcgatcctatccctgaagcgcggcgtaaagccgtaccgggcgttcggttatgcatatcctgccaacaggagaaagatttacataacgcaacattttcaggatataatcgtagaggttcaaaagacagtcagttacgctgacttttctttaccgaaaccgccagtatcatccattcctttacgctcatgctttttagcgttctgcgtcgcagaatgtgccgttaacctcgactctgtaaagccagatgacaagaacggtaaattccaccgttgaattaattaataatcaataggttatttgtcattcaaaaattttgagcaaggccgtcaattctattcgattttatctttcgcaaaaaaccgtgatactcatcacatcgacggaacatcgtcccataaacagaataacctgcgagagattaatcatgaaaaccattaaatatgctgttgcagccatcgcgctttccaccctttcttttggcgcttttgccgcagaaccggttagcgcgtctcagacgcaaaacctgcataaaatcggcgtagtgtctgccgatggcgccaccacgctggatggcctggaagctaaactggctgaaaaagccgccgctgctggcgcaagcgcttataacatcacctccgccgtaggtaatgacaaaatgagcggcactgcggtgatttataaataatttacctgcccgccagatttcaggctgtaacatcgctgttgtttgaattctgacgggtattaccctcgtctgtttgccaacagacccactgctccaaccctcattaaccctgtttgttacccttatttgcccgtccgccactggacgggctttttttattcgctaaaagcctgttcgacgcgcgcaagcccgtcttctaacgtcgccgcctctcccgtcgcaaccagacaacaggccatttgcgtttttaatgattgcggcaccggctcgtggccggcaaggcagcgctcaatccagcgcgcggtgatttcaggatctttagtcgcaggcagtgaaagcggctcgtcgtacgtgtcgctctggcgctcatgcagtacctgcacgccgcggctatcaatcaggctgatttgcggacagcgttgcgggttggcatagacttcgccttcggtaccatgcatcagcaaagcccacccgccaatgcggctaaaaaaggtcgccacacgcagaacatattcaggatgagaaacgcttgataaacgcagcgcggcatcctcagcaaatggcgtcgccagcttggccagtgaatgcgcgctgttacgcacgcccatccgccagcgcatcgctagctgtttttccagcggcgggcagagcgcgctcaccgggataaacaccggctggcgcccgtccagtttggcctgcgcttgtccgccgtgtagggtgggttcaatccccatcagctcaaatatagtttccgtcagtacgcgggtcggatcttcactgacgccgtgtactacgactggaaagcccaatttatgcagcaagatagccagcagcggcgttaaattcgcctgtttacgcgcgccgttatagctgggaataacgaccggcaacggcctatctgcgggcggtgtcagtttgatggcatgattctacatggcttcataaaagcccagcatttcggcttcgccttcgcctttaatacgcagcgccatcaatatactgcccatttccaggtcggggacgtcgccattcagcattcgggtatacaaaccgcgcgcggtatccagatccagatcgcgggcgtgatttttacctcgcccgatctctttgatgatcttgcgataatccattgaaagctccttgaagtgtgctcacagcattaacaccgtcggcggcgtgcaggttttgcttttggttttactataacgtctggcacggcaggctgctctatcggaaaaacaggtaaggcattcagtaaacgctgtccgtagtttttggtcaacaaccgcttatcataaatgaccacttctccccgacaggcgtggctacggatcaatcgccctacctgctgaattaaattaaaagacgcgcttggtaagctttgtacctcaaacggataacgattcagactttttagccattcgccttcggtgatcacgaccgggctgtcgatcggcgggaaggcaattttatggatatggacctgcgtcagtagctcgcctttaagatccagcccttcggcaaaagactgaagcccaaccagcacgctgcgttcgccgctctccacccgtttacggtgcagctccaccagccggtaacgcggctggtcgccctggaccaggaggagtaagcgcacatcagcgacatgctccagaaaacgctgcatcgcccgcccgctggcgaacagtaccagcataccatgatgttttttgctctccagttgctcgcgaaaataggctgccatttcggcaatatgctgctcttcgttatcaatagtgggttcgtagcgcatttgaggaatcaccagtttcccctgttccacatgattaaacggcgaatccagcgccacaaagcggtcgccggctttttcttttaagccgctcatttcctgcaggcgcgaaaagctattgagcgagcgcagtgtcgccgaggtgacaataatgtgcggtacgctgcgccataacaatctttccagctgctcgctgacgcggataccgacacaatggaaccagacgtggagttgcccttcgcgtatttcacgcgtcgcccatttggacaccggcgcgcctgaagactgcgccatcgaagccagtcaccataatttactttgcgcctcgaacattcccagcgcccggttcatctgtaaaatcacccgatgcaaacgcacaatatcgtgcgacccggttttttcgctgagatcgttgagaaaggactccgccagcccacgcaacgtctcggtcagcttcgccagtcgctggcagatttccatgacctcatcaggcaactcgcccattgcaaaacggtgctccgcctcctgcgctgcgggcatatacagattaagaatggcattgagcgaggcgatcagttcgtacacctcctcgcaatgggcgttaagtcgctcaggattcgctaacggcggcgtggtcttagggcgaaattgctccatgcaggtcgccaccagtttgctgaacaggtccagttgcaagcgataccaggaggcggtaatttccgcgctcatctccagcgcatcgcgagcgacatcgggcagatgatgaccttcatccagtaccaacagcagatgctttggttccggcagtacggcttcactttccatcgccgccattactagcgcgtgattcgccaccacgacttccgcttcctgtatttcacgtcgggcgacaaagaatggacattcgcggtaatagtgacagttgcggttcagacaactggctttatcggtacttaatcgccgccacagatcgtcgtcaatagcaatgtcggtatgatcccgcagaccatcccatttgtaaccgtcaagatcccctttcagcctggcgcagcgcttttgctcttcctggttgttaggcgtcagttcgtcatcaagaaaggcgagcagatcctgctgcgtaggctcgctactggcgagcgccgccaggtttcgcggacacacgtaacgcccgcggccaaaggcggcggtaaagcgcagatcggggatgatttttcgtagcagcggcaaatctttgctaaagatctgatcctgtaacgccacgttagcggtactgaccaccagtgttttttgctcttcccgggcaatggcgataccgggaataagataggagagggttttcccgacgccggtcggcgcttcaatagccagatgtctcccttcttccccggccagcgttctggcgacgtcagcaatcatctgccgctgcggcgcacggggaataaagtcgggaatctgatcctgaagcgccttataccaggcggcgatttgcgctttcagcgcagcggtcaatgccatgagaaaacctgaagtactgtataaacagccactattgtgtcacatttcaggggcgggaagtaccttttttgccggttctggaaggcggctcgcaacgcgatgtgtattttgccggatggcggcgcaagcaccttacccggcctacgtatttgcatagtccgtaggcccggtaagcgtcgcgctaccgggcatgttgccggataaaatttactgggcaggcgtgattctgcgcgggcgacgcggcggacgtgctttgtcgccagcgggtttcccctcgcctgtgcgcggttttggtttcgccttcgccgccccgctatcctgacgtcgcggctgctgactgcgccccgctcccccctgattttgtccgcgtccacgaccgccgccaccgccgccgcgctgctgacggccgttctgaatcggctccgctttaatcgacgggtccggctcatagcccggcgtcgtaatgcgtgggatctcttttttcagcaatttttcgatatcacgcaacagtttatgctcgtcaacacagaccagcgacagcgcctcgccagttgccgccgcgcgaccggtacggccaatacggtgtacataatcttccggcacgttcggcagttcatagttgaccacgtgcggcagctcttcaatatccagaccacgcgccgcaatatccgtcgccaccagcacgcgaatatcgccggatttaaaatcggccagcgcgcgggtacgtgcgccctgcgatttattaccgtggatcgccgcgctgcgaataccgtctttattaagctgttccgccagatggttcgcgccatgcttggtgcgggtgaagaccaacacctgctgccagttgccctggccaatcatctgcgacaacagttcacgtttgcgttttttatcgacaaagtgcacgtgctgcgtcacctgctctgaggccgtgttgcggcgcgccacttcgatttccagcgggttgcgcaacagcttttcggcgagcgctttgatgtcgtcggagaacgtggcggagaacagcagattctgacgcttcgccggcagtttcgccagcacgcgacgaatgtcgtgaatgaagcccatatccagcatacggtcggcttcatccagtaccagaatctcaatctgatccagcttcacggcattttgatgttccaggtcgagcagacgtcccggcgtcgccaccagcacatccacgccgccgcgcagtttcatcatctgcggattaatgcttacgccgccaaataccaccagcgagcgaatattgagatatttactgtaatctctgacgttttcaccaatttgcgccgccagctcgcgggttggcgtgaggatcaacgcacgtaccgggcgacgacctttagcgtgcggctgatgggtaatcagatgctgcaacaatggcagggtaaaacccgccgttttaccggttccggtctgggcgctagccatcagatcgcggccttccagcacggcgggaatcgcctgttgctgaataggggtaggttcacggtaaccctgctcggcaatggcgcgcaggatatcagggtttaatcccagggaatcaaaagacataactactccggaccgccccgaccgttaccggtgtagttttcagggagatgctcaaatttggaatgacaaaaaccacaatgtcatgaaggggcggagtgtagcagtttttgtgatgcggcgcataaattatcccgaaaggtggcaaagacaaattaatcgaccacactggacaagtgccattatgagtcataatcttaatcaatcgattgattaataattagggcgtgtgatgaatattcccaccacgaccaccaagggcgagcaggcgaaaagtcagctcattgccgccgcactggcgcagtttggcgagtatggcctccatgccaccacgcgcgatatcgccgcgctggcggggcaaaatattgccgctattacttactatttcggctcaaaagaggatttatacctcgcctgcgcccagtggattgctgattttcttggcgaaaaatttcgcccccatgctgaaaaagcggaacgtctgtttagccagcctgcccctgaccgagacgccatacgcgagctcattctgctcgcctgcaagaacatgattatgctgctgacgcaggaagacaccgttaacctgagcaaatttatttcacgcgagcagctctctcccacatcggcctatcaattggtccatgaacaggttatcgatccgttgcacacctatctgacaagattggttgccgcttataccggctgcgacgccaatgatacgcgcatgattttgcatacccatgccttactgggcgaagtactagcgtttcgtctcggcaaagaaactattctgttacgtaccggctggccgcagtttgatgaagaaaaagcggagctgatttaccagacggtaacctgccacatcgatcttattctgcacggtttaacgcaaaggagtctggactgatgaaaaaacctgtcgttatcggactggtaatcgcagcgatcgtcgctgtgattgccggtggaacctggtggtatcaaagtcggcaggacgatgggctgacgctatacggtaatgtcgatatccgtaccgtcaatatcagctttcgcgtcggcggcaggctggcgtcgctgaatgttgatgaaggcgatactatcaaagccggacaggtgctcggcgaactggatcacgcgccatacgaaaacgcgctgatgcaggcgaaagctggcgtgtcggtcgcgcaggcgcaatatgatttgatgctggcaggctatcgcgatgaagagatagcccaggccgccgccgccgtcagacaggcgcaagccgcctatgactacgcgcaaaacttttataaccgtcagcaaggattgtggaaaagccgcaccatttccgctaacgatctggaaaatgcccgctcatcgcgcgatcaggcgcaggcgacgctgaagtccgcgcaggataaactgagccagtaccgtaccggtaatcgtgaacaggatatcgcccaggcgaaagccagtctggaacaggcaaaggcccaactggcgcaggcgcagcttgatttgcaggacaccacgcttatcgcgcctgccaacggaaccttgctcacccgcgcggtcgagcctggcagtatgctgaacgccggcagcacggtattaacactctcgctgacccgccccgtctgggtgcgcgcctatgtcgatgaacgcaacctcagtcagacgcaaccggggcgcgatattctgctgtataccgatggacgtcctgacaaaccttaccacggcaagattggtttcgtttcccccaccgcggaatttacgccgaaaaccgtcgaaacgccggatctgcgtaccgatctcgtctatcgcctgcgcattatcgtcaccgatgcggacgatgcgttacgccaggggatgccagtcacggtgaaatttaatgacgaggcacggcatgagtgaggccgttattacgctgaacggtctgacgaagcgctttgcgggaatggataaacccgccgtcgcgccgctcgactgtaccattcattccggttatgtcaccgggctggtagggccggacggcgcaggaaaaaccacgctgatgcgtatgctggcgggccagctcaaagccgatggcggcagcgcgtccgtattgggcttcgacccgatacaaaacgacagcgagctgcacgcggttctgggctatatgccgcagaaattcgggctgtatgaagatcttaccgtcatggagaaccttaatctctatgccgatttgcgcagcgttaccggcgagatacgggaaaagacctttgcccgtttgttggagtttaccgccctcggccctttcactggccgtctggcgggaaaattgtccggcgggatgaagcaaaaactggggctggcctgtacgctggtcggcgaaccgaaagtgctgctgttggatgaaccgggcgttggcgttgacccgatttcacggcgcgagttgtggcaaatggtccacgaactggcgggcgacgggatgctgattttatggagcacctcctatctggatgaagccgaacagtgtcgcgatgtgctgctgatgaatgaaggcgagctgctctatcagggcgaacctaaagcgctgacgcaaacgatggccggtcgtagctttctgatgagtagtccacaggaaaacaaccgtaagttactacagagagcgctcagactgccgcaggtgagcgacggcatgattcaggggcgttcggtacgcctgatcctgaaaaaagaggcgaccgcagcagatattcgtcaggccgaagggatgccggaaatcaccctcaatgagaccgcgccgcgtttcgaagatgcgtttatcgatctgcttggcggagcgggaacctcggagtctccgctgggttcaatcctgcatacggttgaaggcactgccggcgaaacggtgattgaagcgcaggaactgacgaaaaaatttggcgatttcgcggccacggaccatgttaatttcgtcgtacaacgcggcgagatttttggcctgctcggcccgaacggcgcgggtaaatcaaccacctttaaaatgatgtgcggcctgctggtgccgacgtccggcaaggcgctggtgctggatatggacctgaaagtcagctccggcaaagcccgtcagcatctgggctatatggcgcaaaaattttcgctttacggcaacctgacggttgagcagaacctgcgttttttctccggcgtctacggtttgcggggccgcgcgcaaaatgaaaaaattcagcgcatgagtgaagcatttggtctgaaaagcatcgcgtcgcatcccaccgatgcgctgccgctgggttttaaacagcgactggcgctggcctgctcgctgatgcacgaaccggatattttattccttgatgaaccaacgtccggggttgatcccctcacccgccgtgaattttggctgcacattaatagcatggtggaaaaaggggtcacggtaatggtgacgacccactttatggatgaggcggaatattgcgatcgcatcggactggtttatcgtgggaagcttatcgccagcggtacgccggacgatctcaaagcgcaggccgccgatgagcaacaggccgatccgacgatggagcaggcctttatcactctcatcaatgactgggataaggagcatacgcatgagtaagtctctctcctggcgccgcgtgcgtgcgttgtgcgtcaaagagacgcgccagatcgtgcgcgatcccagtagctggctgattgcggtggtgatcccgctgctgttgctgtttatttttggttacggcattaacctcgactccagcaagctgcgggtggggattctgcttgaacagcaaagccaggaggcgctggatttcactcatgcgatgaccggttcaccctatatcgacgcgaccattagcgataatcgtcatgaattaattgaaaaaatgcaggccggacgcattcgcggactggtggtgattccggtggatttcgcgcagcaaatggcgcgcgacggtgacagcgcgccgattcaggtgattaccgacggcagcgagccaaataccgccaacttcgttcagggctatgttgaaggcatctggcaaatctggcaacagcagcgcgcggaagatcgcggcgacacctttgaaccgcttatcgacgtccagacgcgctactggtttaacccggcggcgatcagtcagcattttatcattcccggggcggtgaccattatcatgacggtaattggcgccatcctcacctcgctggtcgttgcccgcgaatgggaacgcggcacgatggaggcgctgctctcaaccgaagtgacgcgtgttgaactgctgctgtgtaagcttattccctattattttctcggtatgctggcgatgctgctctgtatgctggtatcggtgtttattctcggcgtgccgtatcgcggttcgctggtaattctgtttatcatcaccagtctgtttttactgagtacgctggggatggggctgttgatttccaccatcactcgcaaccagtttaacgccgcgcaggtggcgctgaacgccgcgtttttgccttcgattatgctgtccggatttatcttccagatagacagtatgcctgcggtgatccgcgcggtgacctatattattccggcgcgctattttgtcagcaccctgcaaagtctgtttctggccggcaatattccggtcgtgttaggcgttaacgtactgtttttaatcgcctcggcggtgatgtttattggcctgacgtggctaaaaaccaaacgacggctggattaaatatgtgtatggataattgtcgtcgtaggccggataaggcgctcacgccgccatccggcattatgcctgatgcgctttgcttatcaggcctacaaactggactgagaggacgggcatgtttcatcgtttatggacgttaattcgcaaagaactgcaatcgcttttacgcgaaccgcaaacgcgcgcgatcctgattctgccggtgctgattcaggtcatcctgtttccgttcgccgcgacgcttgaagtcactaacgcgactatcgccatctataacgaagataacggcaaacattcggtagaacttacccagcgttttgcccgcgcgaaagcgtttacccatgtgctattgctgaacagtccgcaggagatccagccgactatcgatacgcaaaaagcgctgctgctggtgcgcttcccggcggatttctcgcggaatctggataccttccagcctgcgccgatgcaactcattcttgatggacgtaactccaacagcgcgcaaattgccgccaattatctgcaacagatcgtcaaggagtatcagcagacattgatggacggcaagccaaagcccaacaatagcgaactggtggtacgcaactggtataacccgaatctggactacaagtggtttgtggtgccctcgctgatcgccatgatcaccactatcggcgtgatgatcgtcacttcgctgtccgtcgcccgcgagcgtgaacaaggcactctggatcagctgctggtctctccgctcaccacctggcagattttcgtcggcaaagcggtgccggcgctgattgtcgcgaccttccaggccacgatcgtgctggctatcggcatttgggcataccaaattcccttcgccggttcgttagcgctgttttatttcacgatggtgatttacgggctgtcgctggtaggctttggcttgctgatatcagcactttgcgccacgcaacagcaggcgtttatcggcgtctttgtctttatgatgccggcgattttgctctcgggttatgtctcgccggtggaaaatatgccggtctggctgcaaaacctgacgtggataaatcctatccgccactttactgatattactaagcaaatttatcttaaggacgcgagtctggggattgtctggggaagtttgtggccgctactggtgatagcggccaccacgggttcagcggcgtatgcgatgtttagacgcaaagtgatgtagctttttatctttcgccagtagcgagaccacggcgggcccggccaggatagccagccccgccagcgccagtaaaacattgttttgcaatacgcgggatagcagccagaggacaatcagcgcggtgccaaagtaccaggtggtagtcagctcttccagcacatccgccacatcgcgccagcgctgctcatgatggcgctgcaacgccagcatcaatagtaccgtcacgccataaagcacgcataatcccaggccgacgcgcactaatgtgccgctcatccagcctattaccagcatcgccactaccagtaaatgcaacataatctgccaacaaccgaggccggttgcgacacgaacgcgttgttgccacttcatggcttttctcctgaagcatttttctctcattattcagagtaccgaactttacggaaaattccgtaagaccgcatctttttgtgacgacgactacactatttcaatcaggatagtgacgcggacaggaagaaaatgactcaacacacgcgaaatttttcattcaaagtgctcacaattaatacgcacaaaggttttaccgcctttaataaacgcttcatcctgccggagctgcgcgacgccgtcagaacggtcggcgccgatatcgtctgtctgcaagaagtgatgggcgcgcatgaagtgcatccgctgcatatcgaaaactggccggacactacccactatgaatttttggccgacaccatgtggagcgatttcgcctatggccgtaatgcggtctatccggaaggccatcacggtaacgcggttctttctcgctatcccattgaacattatgaaaatcgcggcgtctcggtcggcggtagcgaaaaacgcggcgtgctctattgccgcattacgccgcccatgctcaaccgccctatccacgtcatgtgcgtacatctcggcctgcgggagagccaccgccaggcgcagttaaccatgctggcgggatgggtgaatgccttgccggaatcagaaccggtgctggtggccggagactttaatgactggcggcaaaaggccggcccgccgttaaacgcggccgggctggaggagatattcacccgtgcccatggccgaccggcgcgcacattcccggtgagtatgccgctgctgcgactcgatcgtatttacgtcaagaatgcgaacgccagttctcctggggcgctaccgttgcggaactggcgacatttatcagaccatgccccccttagcgcggagatccatctatgaaatgcggctggcgtgaaggtaatcaaattcagctactggaaaacggcgaccagttctatcctgccgtgtttgaggctatcgctcaggcacagcaaaaaatcattctggaaacctttatcttgtttgaagatgaggtgggtaaaaaactccatgccgctctgctaaaagctgcacagcgcggcgtaaaagccgaagtattactcgacggctacggctctcccgatctcagcgacgcgtttgtcggcgaattaacctcggcgggcgtgatttttcgctattacgacccccgcccgcgtctactggggttgcgaaccaatatcttccgccgaatgcaccgcaaaattgtggtgattgatgatcgtattgcctttgtcggcggcattaactactccgccgaacatatgtcggattacggcccgcaggcgaaacaagactacgcggtacgggtcgaagggcctgttgtggccgatatcctgcaattcgaagtcgagaatctgccggggcaaagccccgcgcgccgctggtggaagcgccatcatcaggctgaagaaaatcgccaccccggcgaagcgcaggcgctgtttgtctggcgggataatgaagaacaccgcgacgatatcgaacgtcattatctgaaaatgctgacccaggcaaagcgtgaagtgattatcgctaacgcctattttttccccggctatcgcttgctccacgcaatgcgtaaagccgcccgccgtggcgtgagcgtaaaactgattgtccagggagaaccagacatgccgatagtcaaagtcggcgcgcggttgctctataactatctggtgaagggcggcgtgcaggtttatgaataccgacgccgtccgctgcatggcaaagtggcgctgatggacgatcactgggccacggtagggtcgagtaatctcgatccgctcagcctgtcgcttaaccttgaagctaacctgatcattcacgatcgtacttttaaccagaccctacgcgataacttacaaggcatcatcgtgaatgattgtaagcaggtcgatgagtctatgctgccgaaacgtacctggtggaacctgaccaaaagcgtgctggcgttccactttttacgccatttcccggcgctggtcggctggctacctgcgcataccccgcatctggcgcaggttcccccgcctgctcagccggaaatggaaacccaggatcgcgttgatccagaaaattcaggagtgaagccctaatggctaaatcgcatccgcgctggcggctggctaaaaaagtgctgacctggctgttttttattgcggtcgtcgttctgctggtggtttatgctaaaaaggtcgactggggtgatgtctggaccgtcatccgcgactataaccgcacggcgcttttaagcgctgtaggactggtgatcgttagctatcttctgtacggctgctacgacctgcttggacggctttattgcggccataagctggcgaagcgacaggtgatgttggtatcgtttgtctgctatgcattcaacctgacgctcagcacctgggtcggcgggatcgggatgcgttaccgactatactctcgcctcggattgcccggcagtactattacgcgcattttctcactcagcattaccactaactggctgggctatattctgcttggcggcatcatttttaccttcggcgttgtccagcttcccgaccactggtatatcgatgaaggcacgctacgtattctcggtatcgttttattgttgattatcgcggtctatctgtggttttgcgcctttgcgaagcggcggcatatgacgattaaagggcagaaactggtgctgccgtcatggaaattcgcgctggcgcagatggcgatctccagcgcgaactggatggcgatgggcgccatcatctggctgctgatgggtcaggatgtgaactatttctttgtactgggcgtactgctggtgagcagtatcgcgggcgtcatcgtgcatattccggcaggcatcggcgtgctggaggccgtattcctcgcgttgctggcgggcgaacatacgtcgcaaggcacgattatcgccgccctgctcgcgtaccgtgtgctttactattttattcccctgttgctggcgctggtgtgctatctgatcctggagagccgggcgaagaagttgcgggcgaaaaacgagcgggcgatggcgaaatgaatttaagcagacgcgttttcgctttccagcacaacgcgttttatccggtaaaaataaacatatgctgagaaaaaagacgtattcatctgtaagcgggaaaaaagcagcaatgaccagctaaacagcagcaggagcacttcgttaaactcacccatgaatactgatgacagggtacagaacgttgccaacgtaacggaaataatggccagcaatagcacataccggtaaataatgaccccgctcatgttcccatgacaatccggtaatgaaatgagaaatcagcgctggcgggcatttcttattaaaatcctcaccgccatttttaatggcgcgagtgacgtctttagcttcacaaaacgctaaccaaaattgtttgccacataatttactcattatacccatcatcaccaacctgaataaaaaacctgcaacacctacggcctgaaagataatagtatttccagaatcatcaaaatgatataacgacacagcgtaaccacagcattaataatgccaaggtaaagcgtcagcgcgccaaataaagcgcaacgaggcagggatgaaaactcgctgtggtataacatgcgggcataaccatgaagtgtcgatttttctagtgctgtaatcaatgtccataccaataccgtcagcacactgactatccagaccagagtgctactggccaccaggctattgacaactatcgcagcgatgatcccgcttaccgccataaaaattaacggcctgaatagaccagaactgatattcaggtagaaaataaataaggcattaagactaaacatgattccaacaatcacgaaaatggtcgcgccacctgagaaaaggtaagctaatgacacgccggtaagcgtaatgatggcaatatatatcaacgttgcgacaacagtgccaaagcgggaaagacaggtaacggccccataccccaggccaagcaaaagtgctgatatccacaaaacaacaacaggttgaacgtgagttatcaaaaaatgactatacaacgttaaccatataataccggcggtacaccatagtcccagcgcagtataccaataggtaagggataacattgtcgcgggaataaatgctatttgccgtatacgtattgcagccagaggtcccacttgtcatttatcactcttcttattatcaccgtaataagaatggcaagcgcaggaaaatatttctaagatgtttatgctgttttgccctaaatatagtcctaaaaaaaatcctggcgcagggccaggattttaagagatcaatatgattagcggcgattgccaaaaatacgcagtaacatcaggaacaagttgataaagtccaggtacagcgttaacgcgccgagaatcgaatacttacgcagattagcgctatcgcgggtatctatttgctcgccgatatttttcagtttctgcgtgtcataggcggtcagaccgacaaacaccaccaccccgatataggttaccgcccacatcagcgcttcactcttcagccagaaattgaccagcgaggccagaacgataccaataagcgccataaacagcatattgccgaaaccgctaagatcgcgtttagtggtgtacccatacaggctcatggcgccaaacattccccccgtcaccacaaacgtgctggcgatggaggaataggtgtaaacgataaaaatactggataacgtcaaatccggttagcgccgaatagagcataaacagcgtcgtcgccattccggcgctaagtttatgcaccagtcccgacagaacaaacaccagcgcaagctgagcaatgattaagccaaagaaggtgatcttactggaaaagacaaacatcatgacggctggcgtattagccgcataccacgcgataaacgcggtcagtaacagtccgaccgtcatccagccatacacttgcgccatataggtctgcaggccagaccgcgcctgcactattgaatcagatcgtggaaatctgtccatgatgaactcctgtgtggaaatgataccctaaagcgtatcacattctgctaccaacgtttcgccaactgctggtcgctgtcgcgcgcttcgacccagcgatcgccttccggcgtggcttcacgcttccagaacggcgcacgggttttcagataatccataatgaactgaccggcgtcgaacgcgctactgcggtgcgcgctggtgacgccgacaaacacaatctcatcgcccggccataattcgccaacgcgatgaatcaccgtgacccgccccagcggccagcgggaacgcgccttcgcgacgatctccgccagagctttctcagtcatgccgggataatgctccagcgtcagcgccttaacgctatcgcccaggttatgattgcgcacttttccggtaaaggtgacgaccgcgccgtcttcgtcgcgcgccgccagccaggaatattcctccccgacgctaaacggcgcagggccgactacaattcgcgtttcgtgcatgttagccccccgtgactggcgggaaaaacgccacttcatcgcccgccgtcagcggatggtcaaaacttaccagcgtctggttgaccgccgccaacagcttgccgtcttccagcgccagcgcccaacgatcgctctttgtcgccagatgctgtcgcagcgactcaacggtggaaaaatctgctggaagatccagcgcatcagttcctgtaagctcgcgaacgtgggcgaagaaaagcactttaatcatgcgcatccaccttaaaatcccccgatttgccgccgcttttcgccagcagacgcaccggaccaattactatatctttttgtaccgctttgcacatgtcgtagatggttaacgccgcgacggacgccgcggttaatgcttccatttcgacgccggttttaccggtcagacggcacagagactcaatacgtacacggttatgctccggctcggcctgaagctgaatctccactttacttagcagtagcgggtggcacagcgggatcagctcccaggtgcgtttagcggcctgaataccggcaatacgggcagtcgcgaaaacatcgcccttgtggtgtttgccatcaacaatcatcgccagcgtttcactacgcatggtaacgaatgcttccgcccgtgcttcacgaacggtttccgctttcgcggaaacgtccaccatgtgcgcttcgcctgcggcgtttatatgggttaattgcgacatcgttatttctttaaatgagggtgaaaattacatgggcgtgtacgggcatccagctgcggcgcaatgatattctcccatgcggttctgcacgcttttgtggagcccggcatggcgaaaatcaaggtgttattcgccacgccagctaccgcgcgcgactgcagagttgcggtgccgatctcttcaaacgagagcatgcgaaacacttcgccaaatccttccacttcacgatcgaacagcggcaacagcgcttccggcgcctgatcgccttcggtcaaaccggtcccgccagttatcaatacgacctgcacctcatcactggcgatccaggcggaaacctgggcgcgaatcgcgtaacggttctctttaacgatggctttcgccaccacttcatgcccggcctcctgcgccgaatcacgcagataatgaccggaggtgtcgtcttcttcgccgcgtcggctggaaacagtaagaatagcgatgcgggtcgggataaattcagcgctgacctgactcatctgaaatctccttattaaggattaaccgccaatgtaagataaattttgcgtaataccagtattgctctggtgaaggaaatgggtctgctttttctcccgcaacgcgtcggaaatacgttcctcaagcgcgtattgctgcgcatcatcctgtaacaggtcgcgtaaactcacgccgccgtcgccaaacagacataaatgcagcttaccgacggacgaaacacgcaggcggttacaggtggcgcagaaatctttttcgtacggcataatgagaccgatctcaccggcgtaatcggggtgacaaaaaacctgcgccggaccatcgctacgctggcggagctggtggatccaaccgcgcttaatcagctcgtcacgtaatacctgacccgaaatatgatgtttgcggaagagatcgctcccctcgcccgtctccataagttcaatgaagcgtagctgaatggggcgaggctgaatccaggcaaggaaggtatccaactgatggtgattcacgtcgcgcatcagcacggtgttgactttcaccttttcgaaaccggcgtcaaaggcggcatcgatgcccgccatcacctggcggaatttgtcctgaccggtaatcgcatggaactgacgcgcatccagactatccacgctaacattgacgcccgtcagccccgcttcgcgccagttcgcggcatcgcgcgccagtcgataaccgttagtggtcaccgcgatctggcgaatagcatcattttcacccacggcggcaatgatgtcggtaaaatcgcggcgtaatgaaggctcgccgccggtaagacgcaccttttccgtgccaagactggcaaaagcgcgcgtaacgcgacgaatttcatcgacggtaaggaaaccgttgttagtgacgccgccaggtttgtagccatccggcagacagtaggtgcaacgaaagttacacacatcggtaatcgacaaacgcaagtagtaaaacttacgcgcgaaagcatcggtaagttgtgaagccatgtacacctttccaaatacgggaggcggagtcatttcttcctgcgccctggtggcaaacgttaaacgttgtcacggccaaagcaccatatcaaaaatgacccaggtgcagaggctagagtgtttattgtggttacgccgatactagcgtgtaaatgacaatttcgccatcacgctttcgctatataaacatatacatagcgatatgatcgtgctatttagcgacagaatacgtgaaaatcacacttttacattgatatatatcatttagccgtggtaacgccctcgctataaaggggtagtcgggaataattaattgtcttttagccggtcggctaattgctgaaaacccgcgacttgcgctactgtagcgctgcttatttgacttcaggaatttttatgcgcaatcgtacgctggctgaccttgatcgtgtcgttgccctcggcggagggcatggattaggacgcgtcctctcctcgctttcttcattaggttcgcgcctgaccggcattgtgactaccacagataacggggggtcaactggccgtattcgccgctcggaaggcgggatcgcctggggcgatatgcgcaactgtctgaatcagttaattaccgaacccagcgtcgcatccgctatgtttgagtaccgttttggcggtaatggcgaactttctggtcataacctcggaaatttgatgttaaaggcgttagatcacctgagcgtgcggcctctggaagcgattaatttaattcgtaatctgcttaaagtggacgcgcagctgatcccgatgtcggagctaccggtagatctgatggcgattgacgatcaggggcatgagatttatggcgaggtgaatatcgatcagttagcgacgccgccgcaggagatcatgttaacgccaaacgttccggcgacgcgggaagcggtacaggccattaatgacgcggatctgattctgattggccctggcagtttttataccagcctgatgccttgcctgctgctggatgaactggcgcaggcgctgcggcgcaccccagcgccaatggtgtatatcggcaatctgggtcgcgaactgagtctgcccgccgccagtttaacgctggtcgataagctggcgatgatggagcaatatattggcaaaaaagtcattgacacagtagtggttgggccgcgagttgacgtcagtgcggtgaacgatcggctggtgattcaggaagtgctggaggccagcgatatcccctatcgccacgatcgtcagttattacacaatgcgctggaaaaagcgctacaggcgttgggttaagcccgtttaccgacgacgctgcgcttatcagaagcctgtttacaccgaagggtaaacaggctctctccctcttctgataaactgcgttcagctatcaccagtaggcgctcatgagcgagctcacctcttttttcagcaatatattctccatgatctcagtaaagagggtctgattgatctcttccattatccgcattccagccatgcgctctgcgtcaggatcacctgctattcctaacgcttccagttcagcattgacccggctctgatactcatccgtttcaatacactcagcccttttggccatcatttcacgccactcttctggcgctatacgctccagcactttatgccacggcccccacagcgcaaaccatttgtgaaaatccctattttcagcaatttttatccttatttccgcctcgtccaggtcagactcagtgatacccgaaacgttataaaatcgcatatcctgggtcattgttgtcagcgacagcgactctcgtaactgattctgaaaacccagatatacttcgatttcgtcaataaaaaacagccgttttaccttttctctggcgagcgattctatttgctccagccgaaagatttcacgccccgccataatcagttccgctaagtggctatcaaaggcgcctctttcagcatcatgaaccaacgtcgcttcctgcatttgatggtatgccagtgtgacccgatcttcacagcttatcgttgcatccatcgctataataaatgcggtttctcttagtgcgctatcatcagccaggcgcattagccaggcggagacttgttccttaaaatccgaatgtcgggtgttctgcgtatcgctaagacgatccagaaacatgctgaaggctgccgcgtttacttccgtctcaaacgcccgccattggttgacgtcttcctcctcgagattggttagccacccctggacagcttgatgcagtggtcgagttacccgaacaattgaaaagtcgcccatggcaaaaaatacctggggtccctgataacccgcagaggacattagccgctgcatattctgtattgttcgttctgaaaaaggattatgttctacgattattcttgtaggttgaggtccttcaccacgaaaacggggtaacgactctgggagacggaccaggcgattgcgagaggcctgcattatttgtaatgccgccgggaggttttccggtagattactcaatgcgttacgggaaacgtccagcgttgttatcgtgggaggtagtgtttcaggcagaacagtaatctgatttttacttacatccaggaactgtaattctggtggtaacgatgcgggcagactggttaaagcattttcgccggcctccagattcttcaggcccggcggcaatgtttcaggcagagcggttaacgaattactctgcacattcaaatgggtaatccctgacggaagatgttctggcagtgtccttatgcggttatcataaacgctcaggtaccgaagttcctcaggtagattttcaggtaaggaactaattttattatgaaaaagatccagcgattgaagcgctgaaggcaaacgttccggcaattcagtaatacggttaatgctcagctccattttctgtatggtatccggtaacgtggcagggatactggttagctgattactgctggcatacagggtctttatatttccctgtaaattttccggcaaacttttcagttcattgttatcgagtatcagagtagttatctgctcaggaatacaggcgggtatagtggtaagtcctaatattttcagacggagttccgtcttattatttttcaggcagtcacgcatccgttgtacggcttcttcacgatttgctgcctcttccgctggcgccgcttttacctactcagaccagattaactcataattcacagtatctttggagccggaagcgctactcgcctgcttgctttctgtcacacgggtataggtgactgacttcccccctccctcaacggtatagccttctgtattaaaaactatagacagaatttcctgactattttcactcaaaatacagtattggtctgcccctcctctactatactgaatattatccgcatacgccgggaaagctaacatccttaaacattcaaacttgcttttgatctcttctggcgaggcggtttcaggtggatgacaaagataagcgattcagctttgtgcttcaacctgatgttctgaagagaaaaaggcacttattttattccatatctcttcttttaaaggcacctctgttgatgcctcattgctaatactttgatgccttgccgtagattgtatattagtaatattaaacatattttccctacctgatctgaacgtaacctaaagtaacagataaggatattctcaactttaaacaagaggccatagtcgtcattatttcggacaaatcattcagtatttgcagcgcttgacttataaatgctcgcgcttccatcacctcttttttaagtagaatgatgtaatctgttgccatgacacgctttcaacgaactcacataagattaaaatgacgatcatgaggatagctataccgataatacggggcgttttttttcatagccgaggagagagggaaaattagcgttgggttcagcctcaacgctaattttcttcagttgtgattaaactagctaccccattgatgttttgactttttcgacaatctcgttagtcaaagcctgtcactgtttttcattcctgactgacttagccctgactattgcactgaaattctcaaaagcgagccatggtaacgatgactcgctggcgatcgacacattgtcaggacgccgcgataaacaactcgcgtaactggtgcaactggtcgcgaatttgcgcggcttcttcaaactccagattttgcgcgtgctgcatcatttgctcttccagttcatgaattttctgctgcaacgctttcggcgtcatatccagttcgacaattccggcttttgccgtagaacggcccttgcctttccccttcgctttggttttcgcaatgttctgccccagcgccaggatgtcgaccacttttttgttcagcccctgcggagtgataccgtgctcttcgttgtacttctgctgcttctcgcgacgtcgctcggtttcgccaatcgccttcgccatcgacggcgtgattttatcgccatacagaatcgctttaccgttaacgttacgcgccgcgcgccctatggtctgaatcagggagcgctcggagcgcaggaagccctctttgtcggcgtccagaatcgccaccagcgagacttccggcatatccagcccttcgcgcagcaggttaatccccaccagaacgtcaaactcgcccagacgcaaatcgcggatgatttccatgcgctccacggtatcaatatctgagtgcaggtaacgcacgcgctcgccgtgctcttccagatattcggtcaaatcttccgccatccgtttggtgagcgtagtgacaaggacacgctcattaatggccgcacgctgacgaatttcggacagcagatcgtccacctgggtcgccaccggacgcacttcaataatcgggtccagcagcccggtcggtcgcacgacctgatccaccacctcatcaccagatttttccagctcatagttgccgggcgtggcggaaacatagatagtttgcggcgctaaggcttcaaactcctcaaacttcagcggacggttatccagcgccgaaggcagacggaagccatactcgaccagcgtctctttgcgcgcccggtcgccgcggtacatgccgcctatctgcgggatggtgacatgagactcatccaccaccagcagtccgtcggcgggcagataatcgaacaaggttggcggcggttcgcccggcccgcggcccgacagaaagcgggaatagttttcaatgcctgagcagtagcccagctcgttcatcatctctaaatcgaactgcgtgcgctggcttaatcgctgctcttcaagcagcttattatttgccagcaagaccttacgcctgtccgccagctcatcttttatctcttccatcgcctgcagaatacgctcgcgcggcgtcacgtagtgcgttttgggatagatagtataacgtggcaccgttgactctacctgcccggttaacgggtcgaacagcgacaggcgttccacttcttcatcaaacagctcaacgcgtagcgcaatgtcgtcagattcagccgggaagatgtcgatcacttcgccgcgcacgcgaaaggtaccacgctgaaaagcttgatcgttacgggtgtattgcaattccgccagccgacgcaaaatcgcgcgctggtcaatcagcattcccaccgtcagatgcagcatcattttcaggtagagatccggatcgcccagaccgtaaatcgcggacacggaagccaccaccacgacatcgcgtcgctcaagcaacgctttcgttgccgacaaccgcatttgctcaatatgttcgtttaccgaagcgtctttttcgataaacgtatccgaacttggcacatacgcttccggctgatagtagtcatagtaggagacgaaatactccaccgcgttttccgggaaaaactctttcatttcgccgtagagctgcgccgccagggttttattgggcgcaagcaccatcgttggccgctgcaagtccgcaatgacgttggcgatggtgaatgtcttcccggagccggtcacgcccaataacgtctgatgcgccagcccgtcctccagcccctcttccagacgacgtatagcgtccggctgatcgccagaaggtttaaaagcggaattcagtttgaacggtttactcatgagcggctacctgaaggagtgagcgggcagggatgtaattttactctcgacggtgaatattgccaataaaaaatactggatgaaaaaacagtaacactccagtgtataatggctatcggcagataccccacgctatttagaggtaaaacatagacagtcgcggggtaaaattccagcagtgtgctggttatccccagaccagagtcttttttaacatttgtcaagtcggatgatgaaagttttatgtcaacgtatcccccttcctttacaaccattgattttatataacttgctgtctaaaaagggatattttctcaagccgtctttcgcgccaatttagtcgcaggccgcgtcgcctctcgcttacgttgtgttttctaactctaatacacaaggttatccacaggaatagtggataactgcttccagcccgtatcccctgccgcctggcaaaatcagcccctgacgttttcgccgggcgataaaaaaaaattatcgctatttttggcagattattggctaacgagaaggcaaaaattgaggcgtagacgctcacattttgcacatttttagcatggcgacgtcaggagggtctggcgaaagaacagcaggatcgtctgatcctgcaagaaggcggtttttaagcgcggtcaggcgcgttccaaggggctaaggtccagatactgtcctgtcgccgcctgcgatggagaaacgcccagccacgggatttcccctaacagcggggccggtatgacgcggcgaagcgtcgcgagatattcaccatgacgcgcgcctggcggctgcatgtcgttggctatccatccgacaagcggtaatccggcctgttctaccgccagcgccgtcagcatggcgtgattaatacagcccagcttgacgccaacaaccagaatcaccggcagctgctccgtctgtacccagtcggcaaacgtcagcgtggcagagagcggtgtaaaccagccgcccgccccttctgtcaacacccagtctgcctgcgcctccagcgttcgtaatccgcgtgataacaccgccgcgtctatcgcccggccttcgtcggcgctagcgatgtggggagaagtaggctcggcaaaagtataaggattgatagcggaataaggttgcggcaggctgctgttacgctgcaaggccagggcatcgctattgcgtagcccgtcggttgtcatttcgctgccggaagcgacgggcttatagcctacggtttgataacctaactgcgttgcggcctgcaataaggcgcaactggcgaccgttttaccgacttcagtatcagtaccggtcacaaaatagcgtttagtcacgttcaatcactcccataaaaaggtggtacgtcagcagatatttcccctgccgctgcggccatgccagttgaatctgtctaagccgggcgcgggttaatacatccgtctcccgcccttcatgaagatgggtggcgccaatgcctttgagcgaacgcatcgcgctcagggcatcctcaaaccacaatgtcatcgcctgagtatgacgagacgcccgccagccgcgtagcgcgtggtcaatggcctcttccggcaaaaagctattcgcgtgagcgcgattatcgacggcctgccatgcctgacgcagctccggcaacgacccctggcacaaggtggtaaacgccaccacgccgccgggccgtacaacccgatacaactcgctcaacgcatcgcgtaaatcgccgcaccactggaccgccaggttgctccaggccaggtcaaaaacttcggcgtcatggggaatcgcttcgatatccgccagcaaatagtgatgcgccgcctgacgatcgcgagcctgttgcagcatcggcagcgaaagatccagggcggtcacttcgctcccccgctctcgccagtaacgactcatacgtccggggccgcagcctgcgtccaacacactggcaaactggcggcctgtcaacagcgtcagcagcgcatccgcgctgtgttgctgtaaagaggcgtgctgttcgtattgcgatgcggcccggccaaacgccgccgcaatagcctgcttattcacctgcgccatgcagcacctccagcagacggtctatatcgcacgcttcatgcgcctgcgttaacgttaagcgcaggcgcgccgtaccgacaggcaccgtcggcggacgaatcgccgtcgcccagcatccttgttgacgcagcgcctccgccaggcgcaatgcacggctgttatcgcccacgattaacggctggatggcgctatgggcattcagtagcgtaaatcgggacgcgttaacgccggcccgaaagcgctgaaccagagcggcgagtttttcgcgccgttcacgaccttcatcgctacggatcaccgccagcgaggcgcttaacgcctgcgcctgggcgggcggcatactggtgctgtaaaccagatgacgggcgaattgcagcagataatctgcgacgctttccgagcagagcaccgctgcgccgctgacgccaaaccccttaccgaaagtcaccaccagcaactcaggcttcaccccccgctgccagcaggtgccccgcccctcatcgccagtcacgccgatgccgtgcgcatcatcaaccaacagccaggcatgatgcctgcgggcaatgtgctggatttccgccagcggcgcgctgtcgccgtccatgctgtatacaccttctgtcaccaccagttgctgacccacgcagggcgattgcagtaaacgcgacagatgctgcgtatcgttatggataaagcggcgaagctgcgccggactcagattagcggcttccagcagggaagcatgactcaacctgtcggccacaatccggtcattttttttcattaaggcggtaatgaccgcctgattcgccgcaaagccagagataaacagcagcgcgcgtggatatcctaaccattgcgccagttcctcctctaacgcctggtgcgccacggaataaccgctgatatgacccgacccgccgctgccgacgccaaaacgcgtcgctgcctgttgccaggcgcgaataatctgcggatgttgacttaagccgaggtaatcattgctggaaaagttaagatactgtcgcccgttcgctaccagccagcgtccggcgccctgcgataccacatagcggcggcgcaacgtatccgtcgcccgacgcgccgtcagcgcatcgtcgacgcgttgttgccaactcataaggctgccgcgttgtaataatcatcggtgtcaggcgtcatcagcgtctgctccagacgttgctgctgctcgttatcgcccgccagcaccctggtctgctgcggattcagccccagcttacggaataactgcagatccttgtcctctgccggatttggcgtagttaacaatttgcagccatagaaaatcgagttcgccccggccataaagcacatcgcctgggtctgctcgttcatctgttcacgtcctgcggaaagacgcacgtatgaggtcggcatcatgatgcgcgctacggcgatagtacgaataaaatcaaacgcatccacgtcatcgttatccgcaagcggcgtgccttttaccttcaccagcatgttgattggcacgctttccggcggcgtaggcaggttcgccaactgcaacaacagtccggcgcgatcggtaaccgtttcgcccagacccacaatgccgccggagcacactttaatccctgcttcacggactttttccagcgtgtcgaggcgctcctgataggtacgggtagtgatgatattgccgtaaaactccggcgaggtatcgaggttgtggttgtagtaatccagcccggcgttagccagacgctgcgcctggctctcgttcaacatgccgagcgtcatacaggtttccagccccatcgctttgacgccctgtacaatcttctccagataaggcatatcgcgttcatgcggattcttccaggccgcccccatacagaagcgggtcgaaccggcgtttttcgctttacgggcggagtccagtacctgctctacctccattaaacgctcggcttccagcccggttttatagcgcgagctctgcgggcagtatttacaatcctccgggcaggcgccggttttgatcgacaacagcgtactaacctgtacctgctgcggatcgaaatgctggcgatgaatttgctgcgcttcaaacagcaattccagcagtggtttttcaaataattcggttacttgcgacagtgtccagcgtgggtggcgagccatcgggcctctccaaaatatgttgtttgtttttgatatggtgtagactcgtaaacctaaatctttttaatttggtttacaagtcgattatgacaacggacgatctggccttcgataaacgccatatttggcatccttacacttccatgacctcgccgctgccggtatatcccgttgagcgggccgaaggctgcgagctggttctcgcctcgggcgaacgcctgattgaggggatgtcctcctggtgggcggccattcatggttataaccacccgcaattgaacgcggcgatgaaagcgcaaattgacgccatgtcgcatgtcatgttcggcggcataacccatcaacctgcggtgaatctgtgccgtaagctggtcgcgataacgcctgagccgctggagtgtgtctttctggccgactctggttcggtgtcggtagaagtggccatgaagatggcgctgcaatactggcaggctcgtggcgaatcgcgtcagcgttttctgacgtttcgccacggttatcatggcgacacgttcggcgcgatgtcggtgtgcgatccggataactccatgcacagcttgtggaaaggctatctgcctgaaaatctgttcgcgccggcgccgcaaagccggatggatggcgaatgggatgaaagcgacatcgcgccatttgcccgcctgatggccgcgcatcgccatgaaatagccgccgtgattctggaacctatcgttcagggcgcgggcgggatgcgcatatatcatccacaatggctcaggcgtattcgtaacatgtgcgatcgcgaaggcattctgctgattgccgatgaaatagccaccgggtttggccgtaccggcaaactgttcgcctgtgagcacgccgggatcgcgccggatattctgtgtctcggcaaagccttaaccggcggtaccatgaccctctcggcaacgctcacgacacgccaggttgcagagactattagcaacggcgaggcggggtgttttatgcatggcccgacgtttatggggaatccgctggcctgcgccgtcgcttgcgccagcctgacgctgctggaaagcggcgaatggcgtcagcaggtggcgtctatcgagtctcagttacgcgctgagttagcccccgcgcaaagttcgccctgggtggcggatgtgcgggtgttgggcgcgattggggtggttgaaactacgcatccggtcaatatggcggcgcttcaacgcttcttcgtcgggcaaggcgtctggatcaggccgttcggcaagctaatctacctgatgccgccctacattattcgtccggatcaactgcgccgtttgacccaggcggtcaatgacgcggtacacaatgaaacattttttagccattaatcagcggtaagcgatgctgcttctggctacacttctggtgagtcaaaaggagagcgcatgaaacttatcagcaacgatttgcgcgatggagataaacttcctcatcgccacgtttttaacggtatgggctatgatggcgataatatttcgccgcatctggcctgggacgacgtgccgatgggcaccaaaagttttgtcgtgacctgttacgatcctgacgcgccgaccggctccggctggtggcactgggtggtggtgaacctcccggcggatacgcgcgtactgacccaggggttcggctcaggcctggtggccgtaccagacggcgtcattcagacgcgtaccgatttcggtaaagcgggctacggcggcgcggcgccgcctaaaggggaaacgcaccgctatatctttacggttcacgcgctggacgtcgagcgtcttgacgttgatgaagacgccagcggcgcgatggtcggctttaacgtgcatttccattcgctcgccagcgcctcgataacggcgatgttcagttaaacgctgtgtcggatggcggcataaacgtcttacccttccaacgggttgggtaagccgaatacgtgccgcgccatccggcaacattcacataaagtccggcaccagacgctgtaacgcgccttgcgccagcagcgtcgtcgcacactcaatatcgggcgcgaaaaaacgatcctgcgtatagtgcgccacccgctcgcgcagtgtctgccgcgcctgttccagtaacgggctggaggttaacccttcccgtaaatctatcccctgacaggcagccagccactccacggcaatgacgccgcgggtattcgccgccatttcccagagtcgccgtcccgccgccggggccattgagacatgatcttcctgattcgccgaggtcggcaggctatccacgctgtgcgggtgcgccagcgctttattctcgctggcaagcgccgcggcggtgacctgggcaatcataaaaccggaattaacgccgccatttttcaccaggaacggcggtaactgcgacatatgtttatccatcatcagcgtgatgcgccgctccgatagcgcgccgatttccgctatcgccagcgccagattatccgccgccatggcaaccggttcagcatggaagttaccgccggagatcacctcccccgcctcggcaaagaccagcggattatcggacaccgcattggcctcagccagcagtacctctttcgtctgacgtaactgggtcagacaagcgcccattacctgcggctggcagcggagggaatacgggtcctgaactttatgacagtggtgatgtgattcagcaatggcgctggtatcggtcagcagatgccggaacaaccgcgcgacgtcaatttgcccctgttgtccgcgcgcggcatgaatgcgcgcatcaaaaggacggcacgatcccagtacggcttcggtagtcagcgcgccgcagacgacggcggaggcaaataattcctgtgcctcaaacaaaccgcgcagcgcgaaggccgtcgacgcctgggtgccgttaagcagcgccagcccctctttggccgccagcgcgacaggttccagtccggccttttttagcgccgcctgcgccggaagccattcgccctgccagcgcgcttttccttcgccaagtagcgtcagcgacagatgcgccagaggcgctaagtcgcccgacgcgccaaccgacccttttgccggaatcagcggatacacgccggcattcaccagagcgatgagcgcctctatcacgctcaaccgaatcccggaaaacccgcgcgccaggctattgattttcaataccatgatcagacgcaccatcgcgtcatccagtgggtcgcctacgcccgcggcgtgagacagcaccaacgatcgctgtagattttgcaagtcttcatcagcgatgcgcgtctgcgccagcaggccgaaaccggtgttgatgccgtaggcggtacgcccttcggcaacaatatcattgacgcacgcaacactggcgttaatgccgtcaatggcgctggcgtccagccgaagctgtaccggatgacgccagacatcgtacagttgagagaggcttaactgccccggagtgagtgtcatggtgttcatatcagcctttcccctgcgtcgccgcaaccatcggtaaattcagaccttgctcaacagcgcattccaccgcgagatcatatccggcatcggcatgacgcatgacgcccgtcgccggatcgttgtgtaacacgcggcgaatacgcgcggcggcctcgtcagtgccatcacagacaatcaccataccggcgtgttgcgaaaaacccatccccaccccgccgccatgatggagcgatacccatgtcgccccgctggcggtattcagcaacgcatttaacagcggccagtcggaaaccgcgtcggaaccgtcgcgcatcgcttcggtttcacggttagggctggcgacagaaccggaatccaggtgatcgcggccaatcacaatgggcgcggatacctcgccgcaacgcaccatttcgttgaacgccagccccagtttttgccgccactccaagcctacccagcagatacgcgccggtagcccctgaaaatgaatgcgctcacgcgccatatccagccagtgatgcagatgtttatcctcagccactatctctttgactttggcatcggttttatagatatcctgcggatcgccggacagcgccacccagcgaaacggcccgatgccacgacagaacagcggacgaatataggctggcacaaatcccggaaaatcaaaggcgttttccacccccatctctttcgccatctggcgaatattgttgccatagtcaaaggtcggcacgcccattttactgaacgccagcatcgcccgaacatgcgccgccatggaacgtttcgctgcctgcatcgtcccccggggatcggattgcgcgtttttctgatactcctcccagcaccagccggagggcaaatagccatgtagcggatcgtgggcgctggtctgatcggtcaccaggtccgggcgcacgccgcgattaaccagttccggcaggatatccgccgcgttcgcgcacagggcgacggacacggctttcccctcgcgggtgtagcgcgtaatgcgggccagcgcgtcatccagcgtggcggcctgctcatccacgtagcgagtacgcagacgaaaatcgatacggctttgctggcattcaatcgtcagcgaacacgctccggccagcgtcgcggctagcggttgcgcgccgcccatgccgcccagcccggcggtcagcgcccagcgtcccgccagcgtgccgttatagtgctgacgccccgcctcgacaaaggtttcgtatgttccctgcacgattccctgactaccgatatagatccagcttccggccgtcatttgaccgtacatcgccagccctttcgcatccagttcgttaaagtgttcccatgtcgcccagtggggaaccaggttggagttggcgattaatacccgcggcgcgttgtcgtgcgttttaaatacgccgaccggtttgccagactgaatcagcaacgtttcgtccgcctccagccgggtgagcgcatcaacaatagcgtcatagcattcccagttgcgcgcggcgcgaccaatcccgccgtagaccaccagctcatgcggattttccgccacgtcaggatcgagattattcattaacatccgcagcggggcttctgtcagccagcttttcgccgttaataccgtgcctcggggcgcgcggatagtctgctgacgatacttgctttcaggcatagcaatgactcctcattattatcggtctgccatcgccaaataacgctaaaacgccactatcaggcaccgccgcagacccacagataagaatcagacatatacttatctatacaagtaagcacaagaatagaattaacaaaaatgatacaattttgttatattgtgtcagcaatcacgttttccggcagcagccgctcaggagataaatcgtccctgtagccggtagcgcgacccggggaaaagtaagcgggcgtgagaaacaatccgcgacgcggaccaggttgtacgacgaatgagcagacaaggctcatgctctttgatagttaaccacgcgcactcttgcgccgtggcgcgcaccgcctccacaatatgttccccttccgttagcggcgcgatccgcgacaaataagcgtgcggcgtggtctgacggtaatcctgcgtcaggtaatccacggcaatatccgcattcacgcagcgatcttcaatttgtaccggcagatcgttttcataatgcaccatgatggaatggaaaatgacatcactctcattgacgttgagagcgctggcctggatggcgtttgcccgcacacgctccagcgtgagcacctcacaacgatgctgatgatggcgggcggcaatctcctcggcgatactgcggacttcaaacagtgcggactggcctttcggttcggcgacaaacgtccccacgccctgtaaacgcaccagccacccttcatccgtcagctcacgcagcgcccggttgatggtcattcggctaaagccatactgagcgaccagttcagcttccgacggaatgcgatcgtgcggctgccagacgccgccggctatttttttacagatgtcctgtttcaccgtttcgtaaaaaggcgcaggcgcagaacgggagcgggatgaatacatgcgtgaagccttccttatgcggataatgttttccggatgacagattaacgccaccagtgcgcgatttgccagccaagccgcgccgccacgcgcgccgctgcgcgcgccgctgcgccatcttcatcaaagcgtggattaaattcaaccagatccgccgcctgtaattttccgctgcggcaaaccggctcaattaaacgcagaacctgtatcagcggcacgcccagcgctgcgggagcggagacggccggcatttcccagacaggcaatacgtcgagatcgatagtcagataaattttatccaccttgtcaataaactgcgtcatctgcgccagcgcgtcatggcagtccagatcctccaccacggtaacattccgccactgcgcttcccgccacaacgcctgcgtattcgccgcacggctcacgccgaaacaagcataatgaaacgcgcggctctgcgcgtcgcatagctgcgccagttgacgaaacggcgtcccggatgttgcccggtcggtctgacggagatccagatgcgcatcaagattaatgatccctacgctttcctgcgcaaacgcgtccagcacccccgcgccgtgtccaaacgcggtttcatgcccgccgcccattaccagcgtgcgcatcccggcccgcagacagcggcttaccgcatcgcgcaaggcctgctgcgcgccttccagatcgggcgtcggcgcaacccaattgcctaaatccaccagccgttcatgtccctgatggctggccatattcgccagcgctttacgcaacgcgtccgggccgcctgccgcgccgggacggcctgaattgcgttttaccccctcgtcgcaggcaaatcccattaacgcgatcttttgctgccagttttcggggaaaaaggcctcgctgcgcgtgacggtctgaaacagacgccgcgcatccggcgcttctatactgtcatcgcgcccctgccagagcgccggagaagccggataccattgcgtcatgagatttgtcctctgtatacccgctgatataaagggttacgccccggctcatacacaatctctaccggctgttcagcatcccacaccacaaaatccgcccggtagccggccctgatctgcccatgcgtcgcctgtcttcccagcgcgcgagcggcatggcgcgtaacgcccgaccatgcctcttccggcgtcagaccaaactgtacgcaggccatattcatcgccagatgcaaactgcaaaacgggctggtgccgggattgaaatcgctggcgacggcgacaggcacctgatagcggcgcagcagttcaaccggcgggcgctgcgtctcgcgcagaaaataaaacgcgccgggcaacaacacgccgacagtaccgccgtcacgcatcgccgcgacgcccgcttcatcaagatattcgatatgatccgccgataaaccctgataacgactcaccagctgcgcgccgcccaacagcgaaagctgctcaacatggcctttaacgggaatacctaacgccttcgccgtctgcaacacgcgctcactctgggccacattaaagccgacgctctcgcaaaagaggtctaccgcatcaaataaccctttttgccagagctgcggaatcatcgtctcgcagaccagagtgatgtagccgtccgggtcgtcacgatactccgctggcgtagcatgagcggccaatagcgtggggctaatgtcgatagcgttttcggcagcaagttttgcagcgacgcgcaacagcttttcttctgtcgccagctccagaccatagccggatttaatctccagcagcgtaacgccttcgctggcaaggcgcatcatgcgttcgcgcgccagcaggtagagcgtctcctccgcacaggcgcgggttgctgataccgtcgcgttaatgccgccgccctgagcgctaatatgctggtatgacgcgccgttaagccgctgctcccactctgcggcgcggttaccggcaaacaccagatgcgtgtggcaatcgataagtcccggggttaccagtcgtccctgcatatcatggatattgtccccactgacaggaagctgcgtctctggcacgatatcgcaaatatgcccttcgcgtacaatcagcgcctggctatccaccagcccgtacggggcttgccgctgcgggtccattgtcgccagcctgatgtttcgccagacagtatcgcccggtaaaagttgccgcattcctgtcgctctcttgcctgtcatgagttgtatagacatttattttctttctgctccggattgtcaactcaaagcgcgaaagttgttgcttaattgtgataaaactatctgatgctacaggtgtttccagcctgaaaaggaactttttaccttttcgccttcccgtttcgttcaacttagtataaaaaagcaggcttcaatggatgtcatttaactttttcaagcccggagcaacctgtgaatacattatcggtttcccgtctggcgctggcactggcttttggcgtgacgctgagcgcctgtagctctacgccacccgatcagatcccttccgatcaaaccgcgcctggcaccgcctcgcgccccattctgtcggcaaatgaagcgaaaaacttcgttgctgcgcgctattttgcctccctgacgccgaataccgccccgtggtcgccgtcgccgattaccctgcccgcacagcctgactttgtggtggggccggcaggtacgccaggcgttacgcacacctcgattcaggccgcgatcgatgcggcaatggttaaacgcacgaacaaacgccagtacattgctattatgccgggcgactatcaggggaccgtgtatgttcccgccgcgccgggaagtctgaccctgtacgggaccggtgaaaaaccgatcgatgtaaaaattgggatggcgattgatggtgaaatgagtgtcgctgactggcgccgcgcagtgaatcccggcgggaaatatatgcctggtaaacccgcctggtatatgttcgataactgccaaagcaaacacgccgcgacgatcggtgtaatgtgttctgccgcgttctggtcgcagaataacggtctgcagctacaaaatctgaccatcgagaacacgctgggcgacagtgtcgatgccggaaaccatccggcggtggcgctgcgtaccgatggcgacaaagtccagattaacaaggtcaatatccttggccgccagaacaccttctttgtgaccaacagcggcgtgcagaaccgtctgcaaaccgatcgccagccgcgtacgctggtgacgaacagctatattgaaggcgatgtggatatggtttccggacgcggcgccgtggtgttcgataacaccaacttccaggtcgtcaactcccgcacacagcaggaagcctacgtcttcgccccggcgacgctgtccaatatttactatggctttttggcgatcaacagccgctttaacgcctccggcgatggcgttgcgcagcttggccgctcgctggatgtcgacgccaacaccaacggtcaggtcgtgatccgcgacagcgtgattaacgagggcttcaacgttgccaaaccgtgggccgacgcggtcatctcgaaacgtccgtttgctggaaatacgggaaccgtggatgacaaagacgaggtgcagcgtaatctgaacgacacgaactacaaccgcatgtgggaatacaacaaccgcggtgtaggcagtaaagtagtgacggaacctaagcagtaatcgccgttccggttcaggcttataaacgggccgccgcagcagatgtggcggcccgtggttttactgcaagcgatgtttattgaaattaatcaggcatcctgccctggtgagctccagcccgccgccctccggcacacagcgctttagtacgcgttcaccacaacccacattggcccctggccgacggcataacggcctttttccgtcagcaacccctgagtgcccgtaatttcatagaccgcgatatgatgtgatttttgacccgcagcaatcaggtatttcctgctgttgtcgatattaaagccgcgcggttgggcttccgtcggctggaagccttcaacgctcagtacgctgccatcttcggagacactaaagacggtaatcagactggcggtgcggtcacaggcatacagatgccgtccatccggcgtaatatgaatatccgccgcccagcgggtatcggaaaaatcggcgggcatcatatccagggtttgtacgcactctatctcgccatgcggatttttaagctgccagacatccaccgaactgttcagttcattgacgcaatacgcatattgtcgattcgggtggaagaccatatgacgcgggcctgccccttcaactgtatttacttccgccggctcctgggccaccagatggccgtcatcgcttagcgtaaacagacaaatgcgatcctgttttagcgcaggcacccacagggtacggttatccggcgtaatatttgccgagtggcagccgtccagcccttccaccacatccaccagctcaaccggcaggccatcctgtaagcgcgtcacgctgacattaccggcgttatacgatccgacaaagacaaaacgaccatgatgatcggtagaaatatgggtcgggctacccggcagggcggattcggcggcaaacgtcagcgcgccatcatccggcgcaatacgatacgccaggacacgaaactccgggcgcacgccgacatagaggtagcgtttatccggactgaccaccatcggctgaacctgaccgggcacatccacgacctgcaccagcgtcagcgtcccttcgtggttcaggctccagacgtgaatttgctgactctcagggctggcggtatagactgtttgtttcatgaatactcctttgcatatggcatgtagctgcaataacaggacacagcttaacgtagtcgcttttgacggcgaatgctgaattcagacgcagaattttgtctgcttaccgtcccggtgtaccatgccgacagacggaattattactcttaatctggaaaaaattatgactgcacgcgtgattgccctcgatttagacggaacattattaaccccgcataaaaccttactcccctcctcgcttgaagcgctatcacgcgccaaagaggcgggctttcaacttatcattgtcactggtcgccatcacgttgctattcatcctttttatcaggcgctggcgctggaaacacctgctatttgctgcaacggcacctatttgtatgattatcaagctaaaactgtcctggatgccgatcctatgcccgtggataaggcgttgcagttgattgatttactggatgagcatcagattcacggcctgatgtatgttgatgacgctatgctttacgaacacccaaccggtcacgtcgtgcgtacctcccggtgggcgcagaccttgccgccggagcaacgtccgacctttacacaggtctcttcgttggcgcaggcggcgcgcgacgtgaatgccgtgtggaagtttgcgcttaccgatgaagatattcccagactacagcggttcggtcagcatgttgaacaggcgcttggcctggagtgtgaatggtcatggcacgatcaggtggatatcgcgcgcaaaggcaacagtaaaggcaagcgccttacccagtggatagaagcgcagggagggtcaatgaaaaatgtgatcgctttcggcgataactacaacgacatcagtatgctggaggcggcaggcaccggcgttgcgatgggcaacgccgatgaggcggtgaaagcgcgcgctgactttgtgatcggcgataacactaccgatagcatcgccaaatttatatacacccacctgctatagtcaggcggtgatagaaacgcttttcacctgcgcgtaaagccacaggccaggcttgatattcagctcatccctggcccacgggcttattcgcgcccacagcgttctgccgcctatttcaagctggacttccacctgcccgttatcgtcataacaattcgccacttttgcccgtaatacgttgcggatactggtctgctgcggcggctgtagtaccagcgagacatccgacgcctgtatacgaatacgcagtgtggattgcagcggctgattgagtttatttacccacaggtgctggtcgccaagcgccagagcggtcatggcataatgcgggtgatgctccagcacgctgactttcagaatactgctctgttgctctttcggcagccacgggtgcataacgctgcttccccagacttcttccagcgggccaaacgctttaacctgtccatcctccagcaccatgactttatccgccaggtggagaatttcatcgagagaatggctgacatacagcatgggaatattgatttctcgcgccagccgttgcaggtacggcagtaattcgcgtttacgcgggatatccagcgaggccaacggttcgtccaacagcagcaactccggggcggtgagcaatgcccggcctatcgctacgcgctgtttttctccgccggacaggctccccggcaggcgatcaagcaacgcttcaattcccagcagcgacaccagcttatcaaactgaccggtcatgcttttcgccatgccatagcgcaaattgccgcgtactttgtaatgggggaacaggcgcgcatcctggaaaacataaccgatgcggcgcttttccggcgttaaacagataccgttttccgcgtcatgcaacacccggccattcagcacgatgcgtccttttcgcgggcgagtcaaaccgctgatggcattaatcagcgaggtttttcccgcgccggagacgccaaagatagccgtgatcccactggctggcagcgtttcgttgagggttaaacagtgcgttcccagcgtctgggaaaaattaagctccagcatggttagcgccccgtccgttcacggctaatccgcgccagccattcagaaatcaacagcgaaatcagcgctaatacaatcgaaatcacgcacagcctcgccgccgcgctctccccgcccggcgtctggatcaaggtatacatggcggaaggtatggtgcgggtttcgcccggaatattggaaacaaaggtaatggtcgcgccaaattcgccaagcgaacgggcaaacgccagcaccgtaccaacaataatacccggcagggtaagcggtaaggtgatagtcagaaaaacgcgccagcgcccggcgcccagcgttctggcggcctgttcaagcttgatatccaccccctccagcgccagccgaatggcccgcaccatcagcgggaaggacatcaccgccgccgccagcacggcgccgcgccagctaaaggcaaacgtgagaccgaaccagtcatacagccactggccaataaacccgcgtcgccccatcgacaccagcagcagatagccgaccaccaccggcggcagcaccagcggcagatgcaggacactatcaagtaaggctttgcccggaaaccggcatcgcaccagtaaccaggcaaaaaagatcccaaacggcaggctaaacagcacggccagggaagacactttcaggctaagaaggacagcctgccattctggatcggtcagtatcattacttcgtcgtaaatccataacgtttaaagattgccgaggcctgcggtcctttcaggtaatcatagaacgcgctgacggccgcatttttatgcccctccacgatagcgatggggtattccacttttttatgtgaatcttccgggaacgtcgccaccacgttgacccccttgctggcgaccgcatcagaaccgtatacaatgcctaaaggcgcttcgttacgttcgaccaacgccaacgcaccgcgcacatcctcgcccggcgccagtttcggttcaagcgtttgccatgcgcccagcttttgcagcgcttctttggcataaattcccgccggtacgtgttgcggatcgcccaccgccagacgcccgccgttcagcagatgaatccagtccgttttgttgtcgatggtaaacggtttctgctcgctggctttcggcgctaccactaccaggctattgccaagcaatgtttcgcgcgtcgtggtatccaccgcttttttatcggctgcgtaatccatccatttctgatcagcagagatgaacaggtccgccggcgcgcccgcttctatctggcgcgccagcgttgaagaggaggcgaatgaggagaccacatccacatttttctcttttttatattctgccgcaatgtcttgcatcgcgttcgttagcgacgcggcggcgaatacggtgatcttgccttcatccgccagcgcatgaccagcgatgacgaaagataatgtcgcccctgcgaccaggcgtaaccaggaatgcgccatctgtaactccttgtgcgtttcgttatgtaaacaacaatataacgataatctcaggggtttcccagcggttattcatacccattaacgattaaacacagaaaatatcggcaggaaaagcaggatcttgagtaacaaaaacgcccgactgagcgggcgtttggggaaatcagcggttctgtctggactggtctttctgaccgataccggaaaaaatgttgaacacctcacccagaccgtaaatcagaccgaggatgatggccatcactaccggtaccatgatgacggcgaataccagactttttaataactctaacatgggcaactccagatatagtcctttttgtattttaaccgcatcacacagaaaagcactccccttttgtgcggtcggctttgcgctgacgcgcttttcagtcacaatagtctttttactaggagctggttatgcaggccgaaatccttcttaccctgaaacttcagcaaaagctttttgccgatccccgacgtatctctctgctgaaacacattgcgctttccggctcgattagtcagggcgcgaaagacgcgggaatcagctataagagcgcctgggatgcgataaacgacatgaaccagcttagcgaacatatgctggttgaacgcgcaacgggcggcaaaggcggcggcggcgcggtattaacccgctatggtcagcgtctgatccagctttacgatttgctgggccaaattcagcaaaaagcgttcgatgtgttaagcgacgatgacgccctgccgcttgacagtctgctggccgctatctcccgcttttcactgcaaaccagcgcccgaaatcagtggttcggcaccattaccgcccgcgatcgcgatcaggtgcaacagcatgtcgacgtgctgctggccgacggcaaaacgcggctcaaagtcgcgctgacggcgcaaagcggcgagcgtctcggcctggaggagggaaaagaagtgctgatcctgctaaaagcgccgtgggttggcattacccgggatgcagccgttgcgcgcgcagctgacaatcagttgtcgggaacgatcagccatatcgagcgcggcgcggaacagtgtgaagtgttgatggcgctgccggacggccagacgctgtgcgccacgataccgactgcggatgccgccacgttaaaggaaggcgatgacgtgattgcctggtttaatgcggacagagtgattattgcaacgttgtgctaagcacattgacatccgttgccgaaagacgtatccctgtcattcatcgctgcaaaaaatgggatgcaaaatgtcatcgttgcaaatttcgcaaggcacgtttcgtctgagcgatacaaaaacacttcatctggattcgctgacgctcaatgcgggcgatagctgggcattcgttggggctaacgggagcgggaagtcggcgctcgcccgcgcgctggcgggtgaactgccattattaacaggcgagcgccagtgtcagtttacccgcattacccgtctgtcctttgaacaattgcaaaagctggtcagcgatgagtggcaacgtaataacaccgatatgctcagtcctggcgaagacgataccgggcgcactaccgcggaaattattcaggatgatgttcaccatcctgcccgctatgcgatgctggcgcagcagtttggcatttccgctttactcaacaggcgttttaaatacctttctaccggcgagacgcgaaaagcgctgctgtgtcaggcgctgatgtctgagccggagttattaatccttgatgaaccgttcgacggacttgacgtgaccgcccgtcaacaactggcacaacgcctgacggcgttgaaccaggcgggtatgaccctggcgctggtactcaaccgttttgatgagatcccggacttcgtgcagtttgccggcgtgcttgccgactgtacgctggcggagaccggaacgacggcagagttactgcaacgggcgttggtcgctcaactcgcgcacagcgagcgtctgaccgacgtacaattacccgaaccggacgaaccttccgcccgccatgcgttacccgatggcgaaccacggatcgtacttaacgatggcgtagtctcgtataacgatcgccctatcctccaccacctaagctggcgagtcaatccgggcgaacactggcagatcgtcggtcctaacggagcgggtaagtctacgttgcttagccttattactggcgatcatccgcaaggctacagcaacgatcttacgctgttcgggcggcggcgaggaagcggcgaaacaatctgggatatcaaaaaacatatcggctacgtcagcagcagtttacatctggattaccgcgtcagtaccacggtacgcaatgtcattctctccggctatttcgattctatcggcatttaccaggccgtttcagacaggcaacgaaaactggcgcaacagtggctggatattctgggaatcgataagcgtacggcggatgcccccttccacagtctctcttggggacagcagcggctggcgctaatcgtgcgcgcgctggttaaacatccgacagtgttgattctggatgagccgctgcaagggttggacccgctgaaccgccaactggtacgccgttttgtggatgtattaattcgccagggagagactcaactgctgttcgtttcccatcatgcagaggatgcgcctgcctgtattacccaccggctggaatttgtaccagagggcgaacgttataagtacgtttccggacgatgcaataattaaatgtattatcagaatggcgccgcgcgccattctggaaccactctccttttattaagaataataataacggtcgataagcttactatctcttgaatcgctgaccgcctcattgtcataataatcctgaaattttcgacaatgatgtcgtatgtgaatacaagggattcattatggcttttcgttttccacaaataatactatttttactggcagccatgttattttgccccagcagttatgctgagcaaaagccgaccgctgcgcaggaagcgcgtaaaaccgccgttgaggtcgctgttgaaggcatgagtcgcgccgccgttgcgggtccgacaaagattagtttaggtgataaagccacgcttaatctaccggaaggatttacctggatacccgcaaaagaagcggcggtatttatgcgtgaaattggtaactatgttgacgatgaatatttttacggtctcgtatttaaaaaggaaatgaatggatttatttctatcgaatatgatgattctggttatgtaaaagatgatgatgcaaaaaactgggatgccgatgaattaatggataacctgcgcaaaggcacaaaagaagcgaataaagatcgtattgcaaaaggcattgagccgatagaaattattggctggatcgagaagcctacctacgatgcaaccaatcatcgtctgatctggtccgccgccatccaggatatcggcaccaacgaaccactgaatgaacaaggcgtgaactacaacacctatctgctgggacgtgaaggttatttttctttaaatctggtgaccaacagaggttctgttgaccacgaaatccctctggcgaaaagaattctcagttccgtcaagttcaacgctggacaacgctacgctgacttcaacgaatcaacggacaaaatagcggagtatgagctcgccgcgctgattggcggtatcgcggccaagaaagtaggactgcttgctatgctcggtatcgcgttacttaaattctggaaagtgaccgccatcggcgtcgtcgctgtcggggcgctcgccaggaagctactctcgcgtaaaaaagactgacagctcctgccccgtccgtttcattcccaggcgcgtaacgcgcctttttttcggataaaaagcagaagcattctcaagtcagatgatttgtaatcatttaattgatataaatgcgtaaaatcaccagcgtgtaaacgattccactaatttattacatgtcacacttttcgcatctttgttatgctatggttattccataccataggcttaacggagcgaattatgagagtattggttacaggtggtagcggttacattggaagtcatacctgcgtacaattgctgcaaaatggtcatgacgtcgtcatcctcgataacctctgcaacagcaagcgcagcgtgctgcccgttattgaacgtctgggcggtaagcacccgacctttgtcgaaggcgatattcgcaacgaagcgcttataaccgaaattctgcacgatcacgcgattgataccgtgattcactttgccggcctgaaagccgtcggcgaatcggtcgccaagccgctggagtactatgacaacaacgtcaacggtacgctgcggttggtcagcgccatgcgtgcggccaacgttaaaaaccttatttttagcccctctgccaccgtttatggcgatcagcccaaaattccttacgtcgaaagttttcctaccggcacgccgcaaagcccctacggcaaaagtaaattgatggtagaacagatcctcaccgatctgcaaaaagcccagccggagtggagtattgcgctgctgcgttatttcaatccggtcggcgcgcacccgtcgggcgacatgggagaagatccgcaaggtattccgaataacctgatgccctatatcgcccaggtcgccgtgggtcgtcgcgaatcgctcgccgttttcggcaacgattacccgaccgaggatggcaccggcgtacgcgattacattcacgttatggacttagccgacgggcacgtcgtggcgatggaaaaactggcggacaaatccggcgtacatatttataacctcggcgcgggtgtcggcagtagcgtcctggatgtggtcaacgcctttagtaaagcctgcggtaaacccattaattaccacttcgcgccgcgtcgcgacggcgatctcccggcgtattgggcggatgccagcaaagccgatcgcgagctgaactggcgcgtcacccgcacgcttgacgaaatggcgcaggacacttggcactggcagtcacgccatccgcagggatactcagattaaggacgttgttatgaccccatttaatcccatcgatcatccgcatcgccgttataacccgcttaccggccagtgggttctggtttcgccgcatcgcgcaaaacgcccctggcagggggcgcaggaaacgccgtctcagcaaatgctgccggcccacgatccggactgcttcttgtgtgcgggcaatacgcgtgtcaccggcgataaaaatcccgattacaaagggacttacgtctttactaacgatttcgcggcgctgatggccgatacgccggatgcgccggacagccacgatccgctgatgcgctgtcagagcgcgcgcggcaccagccgcgtgatctgcttttctcccgatcacagtaaaacgctgccggagttgagcctgcccgcgctgacggaaatcgtcagaacctggcaaacgcagaccgccgagttaggcaaaacctatccgtgggtgcaggtctttgaaaataaaggcgcggcgatgggctgttcgaacccgcatccgcatggacaggtctgggccaacagcttcctgccgaatgaggccgaacgcgaagatcgtttacaaaaagcctatttcgccgaacagcgtccgccaatgctggtagattatgtccagcgagaactggcggacggcagccgcaccgtggtcgaaaccgaacactggctggcggtggtgccttactgggcggcgtggccgttcgaaacgctactgttacccaaaacgcatgtcctgcgcattaccgatttaagcgacgagcagcgcgactctctggcgctggcgttgaaaaagctgaccagtcgttatgacaacctgtttcagtgttccttcccctactcaatgggctggcacggcgcgccgtttaacggtgaagaaaacgcacactggcagttgcacgcgcacttttatccgccgctgctgcgctctgcgaccgtccgtaaatttatggtcggctatgaaatgctggcggaaacccagcgtgatttaaccgcagaacaagcggctgaacgcctgcgcgcggtcagcgacatccattttcgcgaatccggagtataaaaatgaatctgaaagagaaaacgcgcgcgctgtttgctgaaattttcggctaccctgctacccacacgattcaggcgccaggccgcgccaatctgatcggcgagcacactgattacaatgatggttttgttctgccctgcgctatcgattaccagaccgtaattagctgtgcgccgcgcgacgatcgtaccgtacgggtgattgccgccgattacgacaatcaggtggacgaattttcactggatgcgccgatcgtgacccacgatagccagcagtggtctaactatgtgcgcggcgtagtgaaacacctgcaacagcgtaacaacgcgtttggcggcgtggatatggtcatcagcggcaatgtgccgcagggcgccgggttaagctcctccgcttcgctggaagtggcggtgggcaccgtcttccagcagctttatcacctgccgctggacggcgcgcaaattgcgctcaacggacaagaggccgagaaccagtttgtcggctgtaactgcggcattatggatcagctcatctctgcgctcggcaaaaaagatcatgcgttgctgattgattgccgtacgctcggcgccaaagcggtttctatgccgaaaggcgtcgccgtggtgatcatcaacagtaactttaagcgcactctggtgggcagcgagtataatacccgccgtgaacagtgcgaaaccggcgcccgtttcttccagcagccggccctgcgcgatgtcagccttgaggcgttcaatgccgtcgccagcgaactggacccggtagtcgcaaaacgcgttcgccatgtattgagcgaaaatgcgcgcaccgttgaagcggcaagcgcgctggagaaaggtgatttgcaacgtatgggccaactgatggcggagtcccatgcctcaatgcgcgatgatttcgaaattaccgtcccgcagatagacacgctggtagacattgtcaaagcgaccatcggcgatcaaggcggcgtgcgcatgaccggcggcggctttggcggctgtgttgtcgcgctgatcccggaagatctggttcccgctgtgcagcaggccgttgcgcaacagtacgaagcgaaaaccggaatcaaagaaaccttttatgtatgcaaaccgtcacaaggagcaggacagtgctaaatgaaacgcccgcactggcccccgatggtcaaccgtaccgcctgctaaccctgcgcaacagcgcagggatggtggtaacgctgatggactggggagccactcttctttccgcccgtattccgctgtctgacggcagcgttcgggaagcattgctgggctgcgccagcccggaacactaccctgaacagacgtcattcctcggcgcctctattggccgttacgcgaaccgtatcgccaatagccgctatacgtttgccggcgaaaccgtacagttaagcccaagccagggcgagaaccagctacacggcggaccggaaggctttgacaagcgccgctggcaaattgtgaaccaaaacgatcgccaggtattattcgcgctcacctctgatgacggcgaccagggctttcctggccatctttgcgccacggcgcaatatcgtctgaccgatgacaatagaatctccatcacctaccgggcgacggtcgataaaccctgtccggtgaatttgaccaaccacgtctattttaatctggacggcgatcggaccgacgtgcgccaacataagctgcaaattctggcggatgagtatctgccggtagatgaatccggtattccacgccaggggctaaaatcggtagccaatacctcgtttgacttccggatgccaaaagtcattgccagcgagtttctcgccgatgacgatcagcgcaaggttaaaagctacgatcatgctttcctgctacagacgcagggtgatggcaaaaagccggcggcccgtctgtggtcacaggatggaaagctacaaatgatggtttacaccaccgccccggcgctacagttttattccggcaattatctggcgggtacaccttcccgcggaccggaaccttatgccgactggcaagggctggcgctggaaagcgaactgctgccggacagcccgaatcatcctgaatggccgcagcctgactgtatccttcgccctggcgaggagtacgccagcctgaccgagtatcagtttattccgttctaacgatatgccgctacatgcccgatgacgcaagcttatcgggcctacgcgccattgccctgctcaaacctccaccacttaaagacaaaatcgcaactctgagttcacaagaaccttacactgcgccactattttcgctatggttatgcgtaagcattgccgccaacacctcgcggcaatataatgagaattattatcattacatatgatttataggagtgagagtatggctgtaactaagctggttctggtacgtcacggtgaaagtcaatggaacaaagagaaccgtttcaccggctggtatgatgttgacctgtctgaaaaaggcgtaagcgaagcaaaagcagcgggtaaactgctaaaagaagaaggtttcagctttgattttgcctacacttccgtactgaaacgcgctatccatacgctgtggaacgtactggatgaactggatcaggcgtggctgccggtggaaaaatcctggaaactcaatgaacgtcactatggcgcgttgcaagggctgaataaagcggaaacggcagaaaaatatggtgacgagcaggttaagcagtggcgccgcggttttgccgtgacgccgccggaactgaccaaagatgatgagcgttatccgggtcacgatccacgttatgccaaactgagcgagaaagagctgccgttgaccgaaagtctggcgctgaccatcgaccgcgttattccttactggaacgacaccatcctgccgcgtatgaagagcggtgagcgcgtgatcatcgccgctcacggtaactcattgcgtgcgctggtgaaatacctggataacatgagtgaagatgagattcttgagttaaacatcccgaccggcgtgccgctggtgtatgagttcgacgaaaacttcaagccgatcaaacattactatctgggtaacgctgacgaaatcgccgcgaaagcggctgccgtggcgaatcagggtaaagcgaagtaatcacctttgccggatggcggtataactgccttatccggcctacgagcaatgggtaggccggataagcgcagcgccatcaggcaatatgtcttaaacagcgatcacgccgtccagcaccacctgcaatttcccctgcgaacagcgctccacgcgtcctcgtacccggtacacttcagccagacgctccgcagtaatcaccgtctccggcgcgccgctggcgaccagcctgccgtcttttagcatcaggacatggtcaccatgacgcagggcaatattaatgtcatgcgccacgactatcgtcaccctattttgcgcctgggtatcccgacgcacgagatccattacgtgaaactgatagtttaaatccagcgcgctgagcggctcatccagcaacagaagttcagggcgacgaatcagcgattgcgccagacccactaactgccgctgaccgccggaaagctggtcgagatactgcaacgccagatgcgttatgcccaattgctcaaggatagccagtatctgcgctctgccctgcgcattgtctctgccgcctgatgcccgcagtaccacgataatcgactccagtacatgcagatgtacgccctgcggtaatgactgcggcaaaaacacaactttctgcgcccgctcggcaaacgataacgacatgagatcttcgccatcaagcagcgcctcgccgtcgacgttattcagcccggccagcgaacgtagtaacgtcgatttaccacagccgttcggccccagcaaaatggtaattttcccgcgcggcagtaagggaacgttgagatctgcaataaccggctgagtggaatagccggcgctaaatgagcggagcattaacctgcgcatcagagactcccccgatgtcgcaatacaatgcttaaaaagaacggaaccccgaccagcgaggtgacaatccccaccggcaccatgacgcccggaatactatttttcgccgcaatagaggccagcgataacaccagcccgcctatcagcacgctgcccggaaggtagaaacggtgatcttcccccaacagtattcgcgcaatgtgcggcgcaacgagaccaataaaaccaatcggcccgacgaaagctaccgccagcgctgataacaagctgatacgcaacaatgacagcaggcgtaaacggcggacatgaaccccaaagctcatcgccctctcttcgcccagacgtaatgccgtgagttgccaggcgcttcgtaacgcgcaaaaaagcacagcaataaacaccacggccagtacgcccaatttttcccacgacgcgcggaccaggctccccatcgtccagaataccagcccctgcagcgtatcttcatcagccacaaactgcataatggcgaccaacgcgttaaaggtgaataccagcgcaataccgaacaacaccactccggatgcggcgacgcctgtccaacgggtaataccgtccaggagtaacgcggataaaagcgcaaagatgaacgcattggccgggataaaccaggcggcaggaataccgggaataccgatccccaacacaatcgccagcgcagcgccaaaagccgccgcggacgatacgccaagggtaaacggcgtcgccagcggattatttaaaatggtttgcatttcggcgcccgctaaccctaacgccatgcccaccagtagggccatcagggcatagggtaagcggatatcccagacaataacgtgtatgcccgcattcaccttttccggctggaaaagcgcctgccacagcgcactgagcggtaaaccagaagacccacaggttacatccaccatcagtgaaaccatcatcgccagcgcaatagctgacatgagcacggcccgtttgcgtatgatctggcgatagcgcggaatgacgggcgtggaagcgagaccgggggctaaaagtgatttgtcctgacaggtcatggttcgagcgacgttattaatcagaagagaattatagcgccgaattatttcgttatatatttatttatatttcgattgatgacacggtgggctatctcatcggtttccagtaaaaaaccggccttgcgggccggtttaagacgtaatgaagattaacctcgacgggcttttaccgctgccgacaactgacgaagcagcgcatcggtatcttcccagccaatacaggcgtcagtaatgcttttaccgtaggtcagcggctgaccgctttccagactctggtttccttctaccagatgactctctaccatcacgccaataatcgctttttcaccgcccgctatctgctgacagacatcggcgcaaacctccatctgcttttgaaattgcttacaggagttggcatggctgaaatcgatcatgacctgcggcgtcagtcccgctttgatgaggccttctttcacctcagcaacatgttgcgcgctatagtttggcgctttaccgccgcgcagaatgatatggcagtcgccgttgccgctggtattcacaatcgccgaatgaccccatttagtgacggagaggaagcaatgcggcgcgccggcggcgttgatggcgtcaatggcgactttaatcgtgccatcagtaccatttttaaaaccgaccggacaagagaggccagacgccagttcgcgatgaacctgggattcagtagtccgtgcgccaatggcgccccagctcatcagatcggccagatattgcggcgtgatcatatcgaggaattcgccggcggcaggcaggccgctgtcgttaatatccagcagcagtttgcgcgcaatacgcagaccgtcgttaatctggaagctgttatccatgtgcggatcgttaatcagccctttccagccgacggtagtacgcggtttctcaaaatagacgcgcatgacaatttcaagctcgccttgaagctcatcgcgtagcgccagcaaacgggcggcatactctttcgccgctgccggatcatgaattgaacaaggaccgatcaccaccagcagacgatcgtcattgcctttgagaattttatggatggctttgcgtgcgtgagcaacggtatttgctgcattttccgtggcgggaaacttttccagcagcgcgaccggaggtaataactcgttgatttctttaatgcgtaaatcgtcattctgataattcatgtttattccaatgttgccgtacttatcccaatgaatgcaatccctccaatctatctcttcaattaaatagtgtaaacgggcttttacactttgaacggaataatcctggaattcaggaaaaaaacgcacaaatgtagcggaaaatgggatctaacctacactttttaactgtaaccactctgtttatgaattattgcaagattctctgctgcgttaacccgcggcggcgaacgctttttatcccttatttgaggatttgactgacacgtgcactgttggaagaggttatccgacatatccaccataacaggagcatcttatgaaaatgacaaaactgactacgcttttactcaccgctaccctcggccttgccagcggcgcagcgttagctgctgaatctaacgcgcagtccagtaatggccaggcgaactcggcggcaaatgccggtcaggttgccccggacgcccgccagaatgtggcgccgaatgatgtgaataacaacgacatcaataccaacggcaatactaacagcacgatgcagcatcctgacggttcaaccatgaatcatgacggaatgaccaaggatgaagagcataaaaataccatgtgtaaagatggtcgctgcccggatattaataaaaaagtggaaaccggtaatggcgtcaataatgacgtgaataccaaaaccgacggtaccacgcagtaattcagaaaaaagtctgataacgggagagctttcgctctcctttttattttgtcagcgaaaaatcagtatgatatctacagtattgatgagaataacaaaggaatgacgttatggcgcactcacactctcatgccgattcacacctgccgaaagataataatgctcgtcgcctgcttttcgcctttatcgtcactgccggatttatgctccttgaggtggtgggcgggatactctccggctctctggcgttgttggcggatgcgggacatatgctcaccgacgcggcggctcttctctttgcgctgctggtggttcaattttcccgtcgccccccgactgttcgccacacttttggctggctaagactcaccacactggcggcctttgtgaatgccattgcgttggtggtcattacccttctcattgtctgggaagcgatagagcgcttttacacgccacgtccggtggcgggcaatctgatgatggtgattgcggtcgcgggtctgctggcgaacctgtttgcgttctggatactccatcggggaagcgatgaaaaaaacctgaacgtgcgcgctgccgcgctacatgtgatgggcgatttgctgggttccgtcggcgcaatagtcgccgcgttgatcattatctggacgggctggacgccagcggacccgattctctctattctggtttcggtactggtactacgcagcgcctggcgtttgttaaaagatagcgtcaacgaattgctggaaggcgcgccggtttcactggatattaatgccttacagcgccatttaagccgggaaatccccgaagtccgcaacgtacaccatgtgcatgtctggatggtcggcgaaaaaccagtcatgacattgcacgctcaggtcattccgccacacgaccatgatgcgctgctggaacgtatccaggatttcctgatgcacgaataccatattgcgcacgctacgattcaaatggagtatcaaatgtgtcacggcccggactgtcacctgaatcagacgccatccgggcatgttcatcaccattaacgggaaagcgcgcgcgatcctcgctcccgcgcgctgtttatccacaggcgactaccgttcacggcgataaatgtcaggatcagatattccagcgacatcgcatagacgccctgcaaagcaaaaatcaccacactgattacgttgattatcacccacaggagccagttttcgacatatttgcgtgtcatcaaaatcatcgccacgatagacagcaccatcatgcaagagtcccagaacgggaaagcgtccggttgcagtacaggcattgtcacctgtaaccccagcatctgcataatggcgacggccacgcgcgtcaggacggcgaatacgggatcgatatatcgcgtcatcaaaccgatagctatcacacatatcgccagccatgccattgcttttggcaacggcagccagcgtattttaagctcggcctcattatcctttgtttgccgcgaccacgcataccagccataaatattggcggcaaagaaaaagagttgcagcaacaggctggcataaagctggatctgaaagaaaataatcgcaaacagggtgacgttaaccagtccaaaaaagtagttgctgatattctccagactggcaagccaaatacagagcaggccggcgatggttcctaccgcttcgatccatgagagatcgtacccgccagcgccaatcggaatatgaatcagtatgttgtgcgtactaaaaaaatccattctctcccccaaagatttccgtctttacacccgaagtgtagccgcaaaatccagcatccggttgaggggaagtaatgcgctctcgcgtagcgccgcatcaacctgtatttcatgcgccgcgcctccctgctccagcccttcagcaatggctttcaggccgttcatcgccatccacggacaatgcgcgcagctgcgacaggttgccccttcgcccgccgttggtgcttcaagcaactctttatccggaaccgcctgctgcattttgtagaagatgccgcgatcggtcgcgacgataagctgtctgtgcggcagcgtttttgccgccttaataagctgactggtggagcccaccgcatcgcccatctcgacaatggaccgcggcgattcagggtgaaccagaatagcggcatcgggatagattttttttaaacgggtcaacgcctgggttttaaactcgtcatgcacgatacacgccccttgccaacacagtacatcggccctggtctgtttttgcacgtaattccccaggtgtctgtccggcgcccagataattttttcccccaaactatccagatgctcaatcagttctacggcgatactggaggtcacaacccagtccgcacgcgctttaacagcagccgaggtgttagcatagaccactacggttctgtcagggtgcgcatcacaaaaagcgctaaattcgtctattgggcagcctaaatccagcgaacattccgccgccagcgtaggcataagaacgtttttttccgggctgaggattttggcggtttcccccataaaccgtacgcccgctaccagtaacgtggatgcggcgtgcttcgcgccgaaacgggccatttccagcgagtcggaaatacagccgccggtttcttctgctaactgttgaatttccggatcggtgtagtagtgcgccaccatgacggcattgcgctctttgagcaaacgcttgattttctcacgataaaattgcttttcatcgtcgttcaacggcgttggtttcggcgggaacgggtagattgcggcttgtgagtcaaacattacgctcatcgtggcttctcgttttactgacttaacgaaacaaccgaatgaaagcgtaataaacgccacaatcggtcaatttgttttatatgctaaacaagatagctgattcaataaggaaagtcacaataattacgtagtccgtatctgatggcggcgtaacgtcttatctggcctacgtgagcggtgccgtctgtaggcctgataagcgcagcgcatcaggcaagacccgaacctgcggcaggttcgaatcttccatatcgcagatagcaaaaaagcgcctttagggcgcttttttacattggtgggtcgtgcaggattcgaacctgcgaccaattgattaaaagtcaactgctctaccaactgagctaacgaccccttggataagggttactgcttcaatcattcaggatggtgggtcgtgcaggatgactcggcttcgcctcgcccttcgggccgttgctaaagcaacattatccttcacgttctctaccagttaccaccttgtatattggtgggtcgtgcaggattcgaacctgcgaccaattgattaaaagtcaactgctctaccaactgagctaacgacccatacgggtgctgcctgaaagattttactcggaccatctaaagatggtgggtcgtgcaggatgactcggcttcgcctcgccctacgggccgttactgacgcaacgttatccttcacgttcaacatctgagtttgatgttaaattagtgggtcgtgcaggattcgaacctgcgaccaattgattaaaagtcaactgctctaccaactgagctaacgacccacttttacgttgctttcgagttgtttaatatcccgtggcaacggcggcatatattactgatttcagatttgagcgcaacaaaaatttcgacgcagagggctcaactgcttaggaatcgcacgacgcgaccagaaaaaaggcgttttctggtcgcatggtacgcattacatcgcgttaagacgcttctgcgcctgtttcgcgccatcagtgccaggatatttgttaatcacctgctgataaaccgctttcgcttttgccgtatcacctttgtcctgcatgataacgccaactttgtacatcgcgtccgcagccttcggcgacttaggatagttttttactaccgaggcgaaataataggcggcgtcatcttttttacccttgttgtaattcaactggcccagccaataattggcgttcggctgataagtagaatcagggtatttcttgatgaagttctgaaacgccacaatcgcatcatcctggcgagacttatcctgcaccagcgcaattgccgcattgtaatcggtattcgcatcgccactttgtaccggcgcccctgaggttgccgtaccggcatccggagcgggggtcgcagcggttgccgccccgctctggtcgccagctgctggctgcgctgcgccgccattatttaaactccccagctgcagcataatttgcttctggcgctccatcacctgattcagttgatactgattttcctggatttggccgcgcaaagaatcgatatcagactgattatcggagagctgctgctgaagttgggttaaaagctggctgtgagcgttagagatacgctcaagttgagtgacgcggtcttcgaccgagcctgagccgacactactgattggcgcctgagcaaaagcggcccagggggccgctatgccaaccagtaacgacagactcaacaggtgatgtctgaagttactgctcatgcaattctcttagtaaaccagtacagcgcgacggttcttagcgtaagccgcttcgtcgtggcccagtacggcaggtttttctttaccgtaagaaacgatggagatctggtcagcggaaacgcctttaccctgcaggtacattttaacggcgttagcacgacgttcgcccagggagatgttgtactccggagtaccgcgttcgtccgcgtgaccttctacggtgactttgtaagacgggttgctacgcaggaagttagcgtgcgcatccagcattgccgcgaagtcagaacggatatcgtacttgtcgagatcgaagtaaacgatgttgttctgctgcagctgctgcatctgcagacgcgcttgctcttcagatgacatgttgccgttgccgttagcgtccataccagtgccggcgccgttcagcatgccgccttcgctaccgtcattgctggcgttcttgttggaagaacatgccgcgattgccataacaggcagggcaatcatcaggcccttcagcactttgttcagttgcatttctttaattcctttagtaatcaattaattattatcacagatacggcgaccaggcaggcgatttcacctgaccatcagttgccggaagacgcgctttgaaacgcccatctgtagaaaccaaattcagcacagatcccatcccctgagaagagctgtagattaccatcgtgccgttaggtgccagacttggcgtttcatccaggaacgttgacgacagaacctgtacgccacccgtcaccagatcttgtttggcaatgtgctgctgcccgttatttgagcttaccattaccataaatttaccgtcgctgctgacatccgcatcctggttttgcgaaccttcccaggtaatacgctgcgccgcaccgccgttaatgttcattttatacacttgcggacgtccagcctggtcagaagtaaaggccagagtctggctgtccgggaaccaggtcggctccgtattgttgctacgcccgtccgttatctgacgaatctgaccggaggcgagatccataacgtacaggttcagacttccggttttcgataacgcgaacgccagtttcgtcccatccggcgagaaggccggcgcgccgttgtgacgcgggaaggacgcaacctgacgcactgcgccgtttgccagcgtctggataaccagcgcggagcgaccgctttcaaaagtcacgtaagccagttttgagccgtccggagaccacgccggagacatcaacggctgcggagaacggtgcactacgaactgattgtagccatcgtaatccgacacacgcagttcatacgggaactgaccgccgttagtctgtaccacataggcgatacgagtacggaacgcgcccttaatgcccgtcagtttttcaaagacttcgtcactggcggtgtggcctgcataacgcagccactgcttgttcactttataggagttttgcgccagtacagtccccggcgcaccgccagtgtcaaccagctgataagcaacattgtacgaaccgtccggattcggcgtgaccagtccaacgatgacggcatcaatacccagcgcagaccatgcggtaggctgaacttcctgagcggtggctggctgctgcggcagtcgggaccggtctaacggattaaatttaccgctattgcgtaaatctgccgccacgatgccgccgatatcttcaggcgcagcgcccggcccggcccatttaaaaggcacaacgccaatcggtcgcgccgagtccaccccctgggtgatctcgatacggacttctgcgtgcagcactgccgcccacagcatcagaaaaccaaatgctactcgtaatgcctgcttcatcatatctcccatacctgggcctgcgacccacgataatttagcagaatgttaacaaactcaaatacacaaaaccaccaggaccagtaacaactcaaccgctccaacttccataaagaaaagtatctacagtttaaagtctagtttggcatcctttattttctcataaacagcctggcttggcggtttaggaattttcgcggtttttgtcgccattaacgccgcctgacaaagcgccggatcgccgccctcagacgtaatgctttttaatgagccatccggcgccaggctaatatgcaagacacattgtttgccctgatacaggctcgcatcatacagacggctctgaatggcgacctgaatctgtttcgcgtaggcgctgatatcagcgcctgtcgtcccaccgttagcgcccgatgtaccgctatctttcgatggctgaccattccctttcgcgccgccgccggttttcggcgcattcttacccgagctgagatcgccaagcagatcgtcgacgccttctgcggcggccgctttttcggcagccgctttcttcttagcgtccgccgctgctttcgccgcctcggcatccgctttcttcttcgcctccgccgccgctttcgccgcctcggcatccgctttcttcttagcgtccgccgctgccttcgccgcttcggcctccgctttcttcttcgcctccgccgctgctttcgccgcttcggcctctgctttcttcttcgcgtccgccgccgctttcgccgcctcggcctctgctttcttcttcgcgtccgccgccgctttcgccgcctcggcctccgctttcttcttcgcgtccgccgccgctttcgccgcttcttcggcctgttgctgctgttgcgccagttttgccgcttcttcagcctgcttttgctgctcctgagccgctaaacgttctttctcaagttgtttcaaccgctcctgttcagcagcctgcttctgctgcagctcctctgcttgctgctgttgcagctttttacgctcttcttccgcgcctctggcactggcctgttgatcctgctgacggttgtactgctgcacaacggcgccaggatcgaccatcaccgcgtcgatagcggaaccgccgccgccgccggcagaagcctctatatgctcatcaaacgaactccagatcagcactgcaaataagatgatatgcagcacggctgaaataattatcgcccgtttgagcttgtcgttttgttcggttgcctttgacactctcggttcccaaaaaactgttcgcctgttactcgccgtctttcaagccaacgggacgcagacttcagattggctgcgtcattaagccaaccgattttacgcccgcgctgtgtaacaagttcagcgctttaattatttcatcgtacggcacctctttcgcgccgccgattaaaaagactgttttcggattagcctgcagatgacgctttacttctgcgatcacctgttcagacggcagttgatccattcgatctttatcaaccactacgctgtattgccctactccggaaacctcaataatgaccggcggatcgtcgttactactgaccgcctgcgactgattcgcctccggtaagtcgacttccacgctctgggtaatgatcggcgcggttgccataaagatcagcagcagcaccaacagtacgtcgagtagcggtacgatattgatttcggacttaagttcgcgacgacctcgtccacgcgttctggccatggcttaccccttgttgctttcgcttacggtaaacgcctggcggtgcagaatcgcggtaaactcttccataaagttgtcgtaattcagttccagcttgttcacgcgctgattcagtcggttgtaagccataaccgcagggatagcggcaaacagaccaatcgccgtggcaatcaatgcttcggcaatacccggcgcaaccatttgcagagtcgcctgtttcaccgcacccagggcgataaacgcatgcataatcccccatacggtgccaaacagaccgatataaggactgatagagcctaccgtgccaagaaacgggatatgcgtttccagcgtttccagctctcggttcatggagatgcgcatcgcacgcgacgccccctctaccactgcctccggcgcatggctgttggcgcgatggagccggacaaactctttgaacccgctataaaagatttgttccgagcccgacagactatcgcgtctcccctggctttcctggtacagacgcgatagttcgattccggaccagaatttatcttcaaacgcttccgcctcacgcgcagcggcgttcaggatacgcgttcgctggataatgatggcccaggatgctattgaaaaaccaatcaaaatcaacatgataagtttaactagaaggcttgccttcaggaacaaatcaaggatattcatgtcagtcactgcttaaactccgcgacaatagacttaggaagcgcacgaggcttcattttgagtggatcaacgaaaacaatcagaacctctgcttcatttagcagcgtgttctctgcgttgacaatgcgttgcgtgaaaaccaaagcggtgccacgcattgacgtaatttctgtttgaacttcaagcatatcgtcgagccgcgcaggcgcatagtattccagcgtcatcttgcgcaccacaaaggcgacccgctccgccagcagcacctgttggctgaagtgatggtgacgcagcatctccgtgcgcgctctttcataaaaagcgacatagctggcgtgataaaccacaccgccggcgtccgtgtcttcgtaataaactcgaattggccatcgaaacatatacttattcatccctgcagcctctttgttggcgtcatccgcttgccgccgtaatgcctcaagaatgccgttgtatatcgccttgtattcactttacatcccggtaatgcaacaaaagtagagcttttaaacgttgctactatacgcgtaggaatgaggcttgggaatggggggaagttaagggagagtaaaaatatatgggcttatgcaagcccctatatttttaaggaggtttcttattcacaagaagaagaaaatcaggccgacgataaggacgatatccgcaaggagcggacaaaaaatcccttgccagtgtacggattcagggcgaaaacccacgccgtggattatgcctgcgcaaaccgcccacatcagcaataatccgtgccagatttcaagcgtgctggtcctggcggcaaaccgtaacgggtcccagaacatacatcctgccagcactatcgccatcacgaaggaaagcgcccttaagaggcgcttgtccattaccgcataaatatacttcatcctctaagctgcctctttgttggctgcggctgctcaccccagtcacttactgatgtaagctcctggggattcgcagccttgccgccgcgatgcaacttaaatgattttgtatattgcatagcgacaatatgaatcattagctttcttcttgaccggttttacccgcttcaacgtgctcaagcgccagggcggtaatgatcccgaatgcacaggcaagaagcgttcccagaatccatgcgaaataccacattttaagctccttacttagtacagagagtgggtgttgctttcaatatgttctttagtgatacgaccgaacattttccagtaacaccagctggtgtagatcagaataatcggtacgaacaccgccgcaacccaggtcatcaggttcagcgtcatctggctggatgtcgcatcccacatggtcagactggcattcatcatcgtgctggacggcatcacaaatgggaacatagcgatacccgccgtcagaataatgcaggccaacgtcagcgaagagaacaggaatgcccacgcgcctttctccatacgggaagtcaggatagtcagcagcggcagaaccacgcccagagccggaaccaaccacaggatcggagcattattaaagttcactagccaggcgccggcttcgcgcgccacttctttagtcagcgggttagaggcagcatgatgatcaatcgcggatgtcacgacataaccatcaataccatacattacccaaacgcccgccagcgcaaagcacactaatgtcaccagcgccgcaatctgcgaggtggcgcgcgcgcgcaggtgcagttcgccaacggtacgcatttgcaggtaagtcgccccctgcgtgatgatcatccctacgcttacgatacccgccagcagaccaaacgggttcagcaactggaagaagttaccggtatagtacagacgcagatactcatccacatggaacggtacgccctgcaacaggttgccaaaggccacgccaatcaccagcggcggcacaaagctaccgatgaacacgccccagtcccacatgttgcgccagcgcgggtcttcaatcttggaacggtaatcaaaaccgaccggacggaagaacaaagacgccagcaccaggatcatcgccacatagaaaccggagaacgccgcggcgtaaaccatcggccaggcagcaaacaacgcgccgcccgcggtgatcaaccacacctggttaccgtcccagtgcggggcgatagagttaatcataattcgacgttcggtatcgttacgaccgaggaaacgggtgagcatccccacccccatgtcgaacccatcggtgacggcgaaaccaattagcaaaatgccaaccagcagccaccagataaaacgtagtacttcataatcgatcatttgacgactcctgtcttagcgtgccggctgagaagtcacggtggactgctcaaagtgatagcgaccggttttcaggctgcttgggccaaggcgtgcaaatttgaacatcaggaacaattctgccaccaggaacagggtatacaggccgcaaatcaggaacatggagaacagcagatcgcccacggtcagcgatgagttcgccacggctgtcggcaacactttgccgatcgcccacggctgacgaccatactcggcgacgaaccaacctgcttcaaccgcaatccacggcagtggaataccgtacagcgccgcacgcaacagccattttttctcaccgatgcggttacgaatcacgctccagaaggaaagtgcgataatcgccagcagcaggaagccgcacgccaccatgatacggaaagcgaagtacagcggcgcaacgcgaggaatagaatctttcgtcgcttgctggatctgcgcttcggtcgcgtcagtcacattaggcgtatagcgtttcagcagcaggccgtaaccgagatctttcttcatgctgttaaactggtcgcgaacggcctggtcggtagaaccggcgcgcagctgctccagcagctcataagctttcatcccgttacggatacgctcttcatgctgaaccatgagatctttcaggccaataaccggcgtgtccacggaacgcgtagcgataatgccgagcgcataagggatctgaatcgccagatggttttcctgtttgtcctggtcaggaatgccgaacagggtaaaggaggccggagcaggttgcgtttcccattcagcttcaatcgcagcgagcttggttttctgcacgtcgcccatttcgtaaccggattcgtcaccgagtacgataacggacagtacggcagccataccgaagctggcggcaatagcaaaggagcgtttagcaaaggcgaagtcacgacctttcagcatgtagtaagcgctgataccgaggatgaacatcgcgccggtgacatagccggacgccacagtgtgaacaaatttcacctgtgctaccgggttcagcaccagttcagagaagctcaccatttccatacgcatggtttcgaaattgaaatccgcagcgattgggttttgcatccagccgttcgctaccagaatccacaacgcggagaggttggaccccagagccaccagccaggtgacgcacatatgctgaactttacttagacgatcccagccgaagaagaacagacctacaaaggtggattcgaggaagaaggccatcaaaccttcgatggccagcggcgcaccgaagatgtccccaacatagtgggagtagtacgaccagtttgtcccgaactggaactccatggtcaaaccggtagccacacccagagcaaagttgataccaaacaacttgccccagaacttggtcatatctttataaatctgtttgccggaaaggacgtataccgtttccataatggccagcaggaacgccataccgagcgttagcggcacaaacaggaagtggtacatcgcggtcaaggcaaactgtaagcgcgacagttcgactatatctaacatcatgactccttgctcatcgcatgaagactccgagagtgaaccccgttagaaagggtcacacgcatgccccaatacaaatttatttgcggccttccatcgtactatcccctcgggaaggaaacagtaatgatgaaaagttacaaacatgttaataaaaaacccaaattgatcccgcaaatatattacgccgtaaaacccttacaataaacaggtttttagtgggtcagatttgcttttttcgacagcgatcaatttatggctaatctatcgcttttcagggaatttgatcacggacaatttaaccagttttgatgctcttttccaacatttaaatattgattaaaatcaatttttaaagttaatgttaataatgtttattcattgaatgcatggtgaattttttgttaactttttgtttttgcaaagagtaatttcaaaccccctgtaaaaagaggcttattcgataaggctaaacattttgtgcgttttttactgccccgcatccagtaaaaaacattccacattgatgttcaattattgctaaatagctcacagattttttctgcaggttatcaccacttattattttatacatttagtctatttttattttacttataattaacaccgcaaagaaactatctcattgcacacgcgccatcatcccaccgggattaccctgcccgaacttccctttcccgacgactaatggccaggatcatcttaccaggttatcgccttaattatcgctaataagccttccagatagccaggatcaaacaaacattttattagctactttttctttatttcaacaacaccgtatttacctccccataattattatagcgaagattctgtcatcaccttcacagattaacccttaatttctacgtcactcatagtgataattctgtttattcgcagccataaataccctttaaacatgattaatcacgaacgcatagtgtcaataagttcttaataatttttaaagttaacctcttttaaccagcaaaagttcatataatttattaaacgatatctttaatatttcagggaaataatgccggtactcttatgattaaaatagctgttttattctgccattaaacaagcagtctgtgtaagcgcgatacatctgaggagacgtgtagttcgcgctcaggcaaacatgcgcggccacagagtcaagcgtcaatttactatagaggttagcatcaacatagtgtaatgctgcaatgcgtttttttcatggcggaaagcgcataatccgtctccagtgaggtcggcaggtctttcactaagacagcatctgtatttgctgaaaaagagttaaccggcaaactgagtaaatttactgccgctgccagacggttattatcaattattttcagactccaccatgtttttttaatgagtcatcattttcctatacctcaatatttacaaagccaataattttatatcccggatgcttcacccgtactttgccacaaacaataaaaccataaaaaaggccaccgtaaaggtggccaaccatgtcgaaaacggacatttatctgttcccgcaggaacagcgagtttttattttataattgctttcagcgcttcgccgatatcggccaggctgcgaaccgtcttcacgccagccgcttccagagcagcgaatttctcatcagcggtacctttaccaccggcaatgatggcgccagcgtggcccatacgtttgcctttcggcgcggtaacgcccgcgatatagccaacaaccggcttggtcacgtggtctttaatataagccgccgcttcttcttccgcgctgccgccgatctcgccgatcatcacgatcgcttcagtctgcggatcttcctggaacagtttcagaatgtcgatgaagttagagcccggaatcgggtcgccgccgatacccacgcaggtggactggccgaaaccgtagtcggtggtctgcttaaccgcttcataggtcagcgtgccggaacgggaaacgatacccactttacccggcttatgaatgtgacccggcatgatgccgattttgcattcgcccggggtgatcacacctgggcagttcgggccgatcatgcgtacgcccgcttcgtccagcttcactttcacggtcagcatatccagcgtcggaataccttcggtgatggtgataatcagtttgatgcctgcgtcgatcgcttccagaatggagtctttgcagaacggcgccgggacgtagataacggatgcggtcgcaccggtagcttctaccgcttcgcgcacggtgttgaacaccggcagacccagatgcgtggtgccgcctttgcccggcgttacgccgccgaccatttgcgtaccgtaagcaatcgcctgttcggagtggaaagtcccctggctaccggtgaagccctggcagataacgttggtatctttattaattaaaacggacattatttcccctccactgcggcaacaacctgctgagctgcatccgtcagacttttcgctgcaataatattcaggccactgtcagccagtttcttcgcgccgagttcggcgttgttgccttccagacgcaccaccaccggaacgttcacgcccacttcttccaccgcgccgatgataccgtcggcaatcaggtcacaacggacgataccgccgaagatgttaaccagaaccgctttcacgttgtcatccgagaggataattttaaacgcttcggtgacgcgctctttggttgcgccgccgcctacgtcaaggaagttagccggttcgccgccatgcagcttaacgatgtccatggtgcccatcgccaggcccgcgccgttcaccatgcaaccgatgttgccgtccagcgcgacgtagttcagttcccactgtgccgcctgcgcttcacgcgggtcttcctgagactggtcgcgcatttcgcgcagatccggctggcggaacagcgcgttgccgtcagcgcccagcttgccgtcgaggcaaatcagatcgccctgcttagtgatcaccagcggattaatttcgattagcgccaggtcgcgctcaagaaaaatggttgccaggcccataaagattttggtgaactgctgcaccagtttaccttccagacccaatttgaacgccagttcccgtccctgatacggcatcgggccggtcagcggatcgagcgcgactttatggatcagatgcggggtttcctccgcaactttttcgatctctacgccaccttcggtagacgccataaagaccacgcgacgagaactacggtcaaccaccgcgccgaggtacagttctttgccgatgtcggtcgccgcttcaaccagaatctggtttaccggttggccattagcgtctgtttgataggtcaccagacgtttgcccagccagttttccgcaaaggcgcgaatctcttctttgctttttactaccttcacaccgcccgctttgccgcggccgccagcgtgaacctgacatttcactacccacgggccggcaccgattttagacgcggcttcttcggcttcacgcggagtagtacaggcataacccaccggcgccggtaagccatagcgggcaaaaagttgttttgcctgatattcatgtaagttcatgtgttctgtccatccttcaggtaatcgttatctttagacctgtaggcctgaaagctgcgcgccatcaggcattacaccatcgccggatggcggcgtgaacgccttatccggcctacaggtagcaggtgatgctcttgctgactacacgtccaacagcagacgggtcggatcttccagcaactctttgatggtgaccaggaagcccacggattcgcgaccatcgatcaggcgatgatcgtaagagagcgccaggtacatcatcggcaggatttccaccttgccatccaccgccatcggcctgtctttaatagcatgcattcccagaatcgcgctctgcggcgggttgatgatcggggtagacatcagcgaaccgaatacgccgccgttggtaatggtaaagttaccgccggtcaggtcttctacggtcagcttgccgtcgcggcctttgacagccagttctttaatttttttctcgatgtcagccatgcccagcgtatccacgtcacgcaggaccggcgtgaccaggccgcgcggcgtagacaccgccatgctcacatcaaagtagttgtgatacaccacgtcatcgccgtcgatagaggcgttcacttccggataacgcttcagcgcttccactaccgctttcacgtagaaggacataaagcccaggcggataccatgacgtttttcaaacacttcgccatactgcttacgcaaatccataatcggcttcatgttgacttcattgaaggtcgtcagcatggcggtggaatttttcgcttccagcagacgctcggccacgcgcttacgcaggcgggtcattggcacgcgtttttcgccgcgcgcgcccagagcgggttgtgctgcaggttcaacagcgggtgctttagactcgcctttcgccagatgtttttccacatcttcacgggtcagacgcccacccacaccagtgcctttaatggcgctggcttccagattgtgttcagccagcaggcgacggatcgccgggctgagcgcatcgttgttttgttcttccagcgacgcctgctggcgctgtgccggcgtagacgctttctcttcagatttcgcgctggtctctttacccgcgctgttgccttcacgcaggcgacccaggatctggcgagaggtgacagtcgtcccctcttcttccagaaccgcatccagaatgccgtccgctgatgccggtacttccagtaccactttgtcagtttcgatttctaccagcacttcgtcacgaacaaccgcatcgcccggttttttatgccaggtggcgacggtcgcgtccgctacggactcaggcaggtcgggaacaagaatatctacgctactcattatttatcctttatttaatcgacgttcagcgcgtcattaaccagatcttgttgctgtttctggtgaacggacatataccctaccgccggagaggcggaggccgggcgacctgcataacgcagagcggccccaaacggaatcacttcacggaaatgatgctgactgcagtaccatgcgccctggttgagcggctcttcctggcaccagacaaaatcatggacgtgagcgtatggttgcagcgcttcctgcaccgctttatgcgggaacggatagagctgttcgatgcgcacgatagcgacatctttctggtcgtttttgcgacgttgttccagcaggtcgtaataaaccttaccagaacacattaccacgcgttttacggctttagggtccagctcgtcaatttcgccaatggccggctggaaggaaccgttcgccagttcatcaagcgtggaaaccgccagcgggtgacgcagcagcgatttcggcgacatcaccaccagcggacgacgcatcccgcgcagcgcctgacggcgcagcatatggtagacctgcgccggagtggacggtacgcaaacctgcatattctgctcggcgcaaagttgcagataacgttccagacgcgcggaggagtgctccggcccctgcccttcatagccgtgcggcaacagcatcaccagaccgcacatccggccccatttctgctcgccagaggagatgaactggtcaatcactacctgcgcgccgttggcaaaatcgccaaactgcgcttcccagatagtcagggtacgtggttccgccgtggcataaccgtattcaaaagccagtaccgcttcttcagacagcacggagtcccagactttaaactgtccctgaccgctgtgaatatgctgcaacggcgtatacgttgagccgttcgtctggttgtggatcaccgcatgacgatggaagaaggtgccgcgaccggagtcttccccggacaggcgcaccggaatgccttcatcgaccagcgtggcgtaagccagattttccgcgccgccccagtcaaacaatttctcgcctgccgccattgcctgacggtcgccataaattttcgccacgcgagactgcatttcaatggcttccggcacggtgctgatacgttttgccagctcctgcagacgcttcatttctaccttgttcgggtatgcttcatcccattcgtggtttagatacggcgaccaggtgaacgagtgcatattcatcggacgccactctttcaccacgcattcgcctgcatccagcgcatcgcgatagaggttgaccatttcggtggcatcttccagcgttgcgaccttatcagcttccagcttgtcggcgtagattttacgcggcgtcggatgctttttgattttctggtacatcagcggctgggttgcgcttggctcgtcggcttcgttgtggccgtgacggcggtagcacaccagatcgatgaacacatcgcgtttaaaggtattacggaagtccagcgccagacgggtcacaaaagcgacggcttccggatcgtccgcattgacgtggaaaatcggcgcctggaccattttaccgatatcggtgcagtaaggcgttgaacgcgcatccagtgggttagaggtagtgaagcccacctggttgttgataacgatacgtaccgtaccgcccacttcgtaaccgcgcgctttcgacatgttcagggtttcctgaaccacgccctggccggtcaccgcggcgtcgccgtgaatagtgatcggcagcactttattactgctcggttcgtccagtcggtccagacgggcgcgcacggagcccatcaccaccgggctcacaatttccagatgcgatgggttaaacgccagcgccaggtgaaccagaccgccttcagtttcgatatctgacgagaagcccatgtgatacttcacgtcgccggtacccagatgttctttatgtttaccggcaaactcgtcgaacagatcctgcggttttttacccagtacgttgatcagcacgttcagacgaccgcggtgcgccatccccagcaccacttcgcgagtgccgctgttacccgcatggcgaaccatctctttcagcataggtatcagcgcatctcccccctcgagcgagaaacgtttcgcacccgggaatttggcgcccagataacgttccagcccttcagcggcggtcagttcgttcaggaagcgttttttctcgtcagcgctaaaggccgcacgaccggattcgatgcgctgttggatccagcgtttctcttcggtgctggtgatgtgcatatactcagcgccaatcgggccgcagtaggtctgtttgagcgcgtcgagcagctcccccagcttcatcgtctctttgccgctggcaaaggagccgacattgaaggtttcctggaaatcggcctcggtcaaatcatggaaagaagggtccagatccgccacgcgttcttgtttccacagtcccagcggatcgaggtttgcatgctgatggccacggaaacgataagcgttgataagctgcaggactttaacctgcttcacattggtgtcagggtcggaaatcgtagaagagtgacgtgagccagccaacgcctgccgccggaaatattcacgtgtttttgaatggagttgatccggtttgactccggtaccaggtaactgctggaacgtcaaacgccagttagcgtctaccgagtcaggatcggttaagaagtcttcatagagctgttctatccagctctgattcgaaccagagaggtaagaagagtccaaccaggctttcaaagcgctgttctgcatcgtgatcccttaagcatcttttctgcttatttaatactctaaataggtcacgtttcaggaaggcggcaagcttgcgaatccctgggagcttacatccagtaagtgactggggtgagcaagtgcagccaacgcacatgcaacgtgaactatgacgagtatttcgccgtggatactaaccacgcatacgctgtatgcgtgccggggttcacttgttgcggactgtcgtgtcatctgcgtccgctaaggaacctttaaaaactgtctaataatcttcgctgttcaggctacgactgcgttgcggccttcgctcactccggtcacatagttatctatgctcccgaagattcgttcagaccgcgccttgtctcgctctgaacatctcgattattactaatcatatggcagtttttagaggtttcctgcacttctattgcccgatggcacctggcttatcaggcctacagaatacgtaacccgtaggccggataagacggtacgtcgccatccggcaaccactacaactacttacgcgctacgctgcaacagcatcgacttaatatggccgatagcgcgcgtcgggttcagtcccttaggacatacactgacgcagttcataatgctgtgacagcggaatacgctgaatgcatcgctcatcccttccagacgactgtcagtctcggtatcacgactatcgatcaggaatcgatacgccgcgagcagccccgccggaccgataaacttatccgggttccaccagaatgacgggcaggatgttgagcaacaggcgcaaagaatacattcatacagcccatcgagtttttcacgctgctccggcatctgtaaatgctcacgtgccggtggattttgcccattattcaataagtaaggcttaatcttctcatattgtgcgtagaattgccccatgtctaccaccaaatcgcggatcaccggcaaaccgggcagcgggcgaatcacaatcttcttacccgactgagtcagcgccgaaataggagtaatacaggccagaccattcttaccgttcatattcaaaccatcagaaccacacacaccttcgcggcaggaacggcggaaagaaaggctgggatctttttctttaagctggattaacgcatccagcagcatcatgtcgcgcccttcttcgccttccagggtgtaatcctgcatacgcggagcgttatcgacatccgggttataacgataaatcgaaaattcgagtttcatcatcctgtctccgcaattaataagtacgaatcttcggcgggaacgccggacgcagtttcggttccatattgacgcttcggcgcgtcatggattccgtttgcggctgatacagggtatgacacaaccagttggcatcatcacgctccgggaaatcgaagcggctatgcgcgccgcggctttccgtccggaagttggctgatacggcagtggcgtaggcggtttccatcaggttatccagctccagacactcaacacgctgggtattaaactcgctggacgtgtcatccagacgggcgtttttcagacgctcgcggatcactttcaactgctcaagccctttcgccatcgcgtcgccttcacggaatacggagaagttatgctgcatacactcctgcaatgctttgcggatagccaccggatcttcgccattgcggttattgttccagcgattcaggcgatccagagaaccttcaacgtcagactcgctggcgtcgcgcagcacgccctgctcggcgatggattcctgtaaatgcagccccgccgcgcggccaaagaccaccagatccagcagtgagttaccgcccagacggttggcgccgtgaaccgatacacaggcgatttcgcctaccgcaaacagccccggaatcaccacgtcttcgccctgctcgttcacggtcagcgcctgaccggtcactttagtcggaataccgcccatcatgtagtggcaggtcgggataaccggaatcggctctttcaccggatcgacgtgagcgaaagtgcgggacagctccaggatacccggcaggcgagattccagcacctctttacccagatgatccagtttcagtttagcgtgcggcccccacggaccatcacagccgcgaccttcacggatttcgatcatgatggaacgcgccaccacgtcacgacccgcaaggtctttggcgttcggcgcataacactccataaagcgctcgccgtgtttgttcagcaggtaaccgccttcgccgcggcagccttctgtcaccagcacgcccgccccggcgatgccggtcgggtggaactgccacatttccatatcctgcaccgggacaccggcacgcagcgccataccgacaccgtcaccggtattgatatgagcgttggtggtggactggtagatacggcctgcgccgccggtcgccagcaccgtcgcgcgagctttgaagtacaccacttcacaggtttcgatgcacagtgcggtacaccccaccaccgcgccatcctggtttttcaccagatccagcgcataccattcggagaaaatcgtggtgtggtttttcaaattctgttgatacagcgtatgtagcaaggcgtgaccggtacggtcagccgccgccgcggtacgtgccgcctgctcgccgccaaagtttttcgactggccgccgaacgggcgctgatagatacgtccatcatcaagacgggagaacggtagccccatgtgctccagttccagaatcgcttccggtccggtcttacacatatattcgatggcatcctggtcaccaatgtagtccgacccttttacggtgtcgtacatgtgccattcccagttatcttcatgggtattgccgagcgccacggtgataccgccctgcgcggaaacggtatgggaacgggtcgggaagactttcgagagcagcgcacaggtttggccgctctgggaaatttgcagcgccgcgcgcatacctgcgccaccggcaccaatcacaacagcatcaaattctctgactggcagtttcattacacaccccacaccacaacaaatccatagatgacgtaaaccaccagcgcaacaacaataacgagttgcagtatcagacgcactgccagtggtttaacgtagtcggttaacacctgccacatgccgatccaggcatgaattaagatggaaaaaagcgccagcagagtgaagactttggtgaaggccgatgagaagaaaccggtccaggcttcaaaggtcagttcgccgctcgtggcgaaaaaacccaccatgtagatgatgtataacgtcagaacgatagcggtagcacggaccaggatgaagtcatgtacgccattgcgtcctaatgcggaggcgttgcttaccatacgaggactcctgcgagaagtgaaagcacgacagtgataacaaaagagattttggcagagcgttgacccgcttcgaatgtttcttccagatagccaaaatccattaacatgtgacgaattcccacgatgacgtgatacgccagcgcggtaaggatgccccacatgataaatttaacgatgaagccgtccatgatgtcggcggcctgctggaatccttccggagaagagaggctggtgcccagtagccacagtagtatgccgacggcgatgaaagtaatcacaccggatacgcgatggagaatggacgctatcgctgtgatggggaaccgaatcgtttgtagatccagattgacaggtctttgttttttcacatttcttatcatgaataacgcccacatgctgttcttattattcccttaagacttcggttacagaggtgaatctacctgtagccagaaagacgacgggatttccttcctccggtctgcgtgcgggtcagacagcgtcctttctataactgcgcgtcatgtaaaacactgcttccagtagctaaaacgacacgttacaacgctgggtggctcgggattgcagggtattccggagacctggcggcagtataggacgttcacaaaatcattacaattaacctacatatagtttgtcgggttttatcctgaacagtgacacaggtcacgataacaacatttttttaattttcaatcatctgatttgacaaacattaaacaaaattgttacaaacaacaccagaaaaagcatataatgcgtaaaagttatggggtcactctttcacctgttaataagttatgtaacagtacaatgatattgacccattctttcaggacagttattagtgatagacaggttacattactcggattgctacgttcctgatttgctgctaattcgaaattaatcaagccgttacctgcaaacgcccattgctctgtacccaggtcatcccctctttcacagagcggcgagccaaataacaaactggtaacggttgattgatgcatacacagaattttccctgcactaacgacgaggaagatgacgtggagaaggcaagtctgagttccggcagtcttaagcaataaggcgctaaggagaccgtaaatggctgatacaaaggcaaaaatcacccttactggtgacactgctattgaactggatgtgctaaaaggcacactcggtcaagatgttattgatattcgtagtctcggttcaaaaggagtttttacttttgaccctggtttcacctctaccgcatcctgcgaatctaaaatcaccttcatcgacggcgacgaaggcattttgttgcatcgcggtttcccgattgaccagcttgctaccgattccaactatctggaagtctgttacatcctgctgtacggcgaaaaaccgacgcaggaagagtatgacgagttcagaacgacagtcacccgccatacgatgatccatgagcaaatcactcgcctgttccatgctttccgtcgcgactcacatccgatggcggtaatgtgcgggatcactggcgcgctggcggcgttctaccacgactcgctggatgtgaacaatccgcgccaccgtgaaatcgcggcgttccgcctgctgtccaaaatgccgaccatggcggcgatgtgttacaaatattcaatcggtcagccgtttgtttatccgcgcaacgacctttcctacgccggtaacttcctgaacatgatgttctccacgccgtgtgaaacctatgaagtgaatccggtactggagcgcgcgatggaccgtattctgatcctgcacgctgaccatgagcagaacgcctctacgtcaacggtacgtaccgcaggttcaagcggcgccaacccgttcgcctgcattgccgccgggatcgcctccctgtggggacccgcgcacggcggcgccaacgaagccgcgctgaaaatgctggaagaaatcagctctgttaaacacattccggaatttgttcgccgtgcgaaagacaagaatgattctttccgcctgatgggcttcggtcaccgtgtttacaaaaactacgatccgcgcgccaccgtgatgcgtgaaacctgccacgaagtgctgaaagagctgggcaccaaagacgatctgctggaagtggcgatggggcttgagcacattgcgctcaacgacccgtacttcatcgagaagaaactgtacccgaacgtagacttctactccggcatcattctgaaagcgatgggcattccgtcctctatgttcaccgtgatcttcgccatggcgcgtaccgttggctggattgcacactggaatgaaatgcacactgacggcatgaaaatcgcccgtcctcgtcagctgtataccggctacgataaacgcgattttaaatcggcgctgaagcgttaattgacaaccggatggcgacgcaaccctcgccatccggtacattttcccttttttcttatcctcattattttattcttaccccgttactctctatgattaattaaggtttcgctaaatatcattcagggagcatggaatgccgattttgcagtggtttttgttgttcctgttatcgctgctcatttcccttatttttctctatctgcaccttccggcggcgatgctgcttggtccaatgattgcgggtatcgtgttgagtttgcgaggtagcacgctacaacttcctcgcggtatttttctcgccgcgcaggcgattctcggctgtatgatcgcccaaaatctaaccggttcgatattgaccaccctcgccctctactggccggtcgtgctttttgtgttgctggtgacgctgctttccagcgcggtagtcggctggctgctggtacgttacagctcgctgcccggcaacaccggcgcatgggggtcttcgccgggcggcgcggcggcaatggtagcgatggcgcaagattacggggcggatatccgcctggtggcgtttatgcagtatctacgggtactgtttgtggctggcgcggcggtgctggtgacacgcctgatactcggcgacagcgcggcaacggtcagccaacaggtggtctggtttccgccgcttagcggtaatttattgacgacgctgctattagcgatcgtggcgggcattgccggtcgcctgatgcgtatcccttccggcacgatgctgctccccatgttggcaggcgcgcttctccattcgcaaggcatcattgaaattgaattacccgaatggctgctggccgtggcgtatatggcgataggctggcgtattgggctgggttttgacagacaggtgttttttatggcgctgcggccattgccgcaaatcttattgtcaattttcgcgctgatggcgatttgcgccgcgatggcgtggggaatggcttactacatgcagattgattttatgacggcttatctcgccaccagtcccgggggtctggatacggttgccgcgatcgcggcaggaagcagtgccgatatggcgctcatcatggcaatgcaaaccctacggctgttcagcattctgttaactgggccagcagtggcccgttttatatcaacctatgcgcccaaacaacctttgtagggctgataagcgtcgcgccatcagacaatagccgctcgccgatggcggttccggctatttctggcaatgcgcgcaccagtaaaacgggcgtgaggaaagtgttgtcttttcaataatgccgccgcaccgctcgcacgcttcaccgtcacggtggaaaaccttaaagcgaaacagtgcgccatgatgcttgttctcatccgcctgaccgcgagtcgtgtaggaaaggcgcggaatatccaacagcgcgtgagaaagcgcattcagttgcgcctcgttgagatctttcgctttatgctgtccggttaatcctacctgccagaggatttcaacgcgcagataattccccagtcccgccagaaaggactgatccagcaacagcccggaaaattgtcggttgcgaaaacgcggcgacagcaatcgagctttaacctcttccggagtaagacgcgcgtccaacacatccggaccgactcgctgtaaaaaagggtgcgtcatgagctgctctgctgtcagcatttcgatatcagacgcgctataaagcagaataattttatccgccgtttgtagcctgacgcgtaatatacgcgtggtctgcggtatttcaccggtgtcgatcacccgccatacgccatagagttggttgtggctgtagagcgtcaggccatttgaaaagtgggtcaataacgcttttccccgcgtctctatccgggtaacaagttgaccggtaagctgcgattcatacggttttaactgtgcaaaggcaaaccagacatcggttaagggtttgcctttgattgccgcctccagattatccgccgcacgacgaatttccgggccttcaggcatgataatatcctttgttaacagttgattaatggactaccccgcctctgactgtctggaatgcacatcgaacgccataatgaatatccacagcggatggacaaacaggcggtggtatccagtgataataacattatcgcagcacgagaccacttccccgtcagggttaacgtgatcgcgccagggcataatcgactcagcccttgtcgggcgagcgcctaataatgattgtctgcctaccgaaattaaatgacgcttagttatattttgcccaaaatttttttctgttgagccttttaaagccttctttccaataactggcattcaactctttgatataattttctccgggaaaaagtttatcctttaaaggcagttttttggctagcacgattctttctgcgttagatcccgcggactctgaatgtgtgagggaagataaggcgtccagttgagcgcttgagggtctggctatcaattcaaaaaaaggttctgacaatacaacactactaagtgctgcataatttcctttttgtatgagcggtttgacgtactcaaaaaaagaaataatccctgattgcaatcttgccgctttttttaaatactcaatttcagaaccactgctatcttcacgtacaggaattattccattatccgtttttttatagccaattgttgacccagtattatcagccatagcgaactccattatttccacccctcctgataagaaaagatcacacttatcgtggggatggccatagttggttagataaccaaacatcttattataaatagatcggttatcattggcgccagcaaaagttgccaaataaaacccatgtatttgtttttctgcccattgcgcacctaaagaacgagcaaatactgattgaatattacccatccatcctacatcgataagtgctatatttttaaaaccttcacaggccgttttaaagtagatggaaagcagacacttgtttaagtaataaagacttacaaatagattcacccataatatctttagctttccaatgattagatatcccatgattatactctgaccaatcagcatggagagtatttatgccgagttttttagcattcagaatatcagcatgaacattatcgccaacatgtatccacgatgcaatatctacattttcatttttcttgactattgaaaataatttaccactatttttagagtaccgctcttcgccagatgaataaactggaatgttactgatatcatagccacatgatgttaacaactcctttaatattgctgatggaaggtacatatcactaattaaaatgactttgcaaccatcactaatagccttttcaaacaaacagcttccacgcgcatttttatataaaacaatcttctccatttgtatttccagatcgattatcttttttactgtcgctggtgaaagctgcggatgcttttttaaaatttcatcgtatatttcagatataagtatttccggctcgccgccaaaacgcctgaccctattctctctggcacttacttccgcctgaactcttatctctgggaaattatcaataataccaatctcgtacgctgatataaaaaatttctcagttgctaaagttgattgcattaatgaaaacaaatctctgggacggtaaatcctccggctaaccaatgtatcaaagatatcaaagcttacggtcttgtattttttaaagttcatatccatattttatttaatcttattttcaatataagaaattttatgaaaaagactattgttagcaatatttgaaagtaacacattgagcaatgatgagtcatcaatacttctcatcattttattttctgcaattttgcactctatatcaaataactcattgttaattacggtataattgccaaattcaaagtcatcattttctctgaaatgataaaatgccagtgcttcaggtaagatccaaacatcattttctgccagataatgaataaaaaaaggccagaaaaatgcaggagaggataatttatgactttcaatcacatcgataacagaatttttatcgaataaacacgaggatagtggaatagaattcctgtaataaataacatcaaaactaacagggccagcatttaaatagtggttccatggttgcgttgaatttataattattctattattttccgcaatctcagcaactttatttgtatggcatgctattgcatttacagatgaatacgttgactgtatattcgccaaaacactgagtagccttgacacatattcaggggcccaggaatcgtcatcatccataaagcataaataattagattcagacatcttaatagcattaaagatacagttttcgtcgtagataacactatatatatttgacagttctttcagataaaaatcatccacattgtgacatttcaattcttcctccatgcagaaaatgataatatttatttttttgaacgtctggtcattaatggattgcaaggcccgcattaatagacgagtacgcccaggtttatgtcggacaataactaaaagactcttttccatattctgatttcgcgttttacggtatatataaaaattaacaccctatgaatgaatgctgacattgggtaaggattataatattttattagactgacaccagataaggtgtagcaacagaaccatacctaagattatcatagtcatataattaaaaaatcggtataattctcatcaacaccacttacatcatgtttaatatttatcttcagattttttattgaattttttataccaaaagagctttgaggtaagatagggcaaactatttttcatctctttttttgcagatttaaaccgataaaaatttttgactgccgtaaacaaaccattaataataactttaaaaaactccatttttgagtgggtaagttttaataatttgccattttctatatttaaatgatagatagtaattctccggaatgaaaacttagtagggtgataatgacgataatcaaccaggattggttttttaattaaaaagaaagctggaattaagtgtccattaagggttatgcatctaaaaaatttgtagatggctttttctttaccagaacatgggtaatcaacacaaccattaacaatatcaataccttctacattgaatttttcattatgagttattgcattaattctttttcttatctccagaagatctacattatcttcccaaaactcccgtccagaaagacaatcgttatatgacataatcattgctctggcaagttcatagcggcatgaaaaactcgcaagaaagacttcccgcacaaagaaaacacttaacagtagtgcagcaaactttcttttactaattaatgcaggtacagcaacagtcctgaagttcaaatagctatttagaaccgatatttttctttcaaaatccatttgccacgaagccacaccattaagtgtgacaatattatgttttttatgcatatatccaaatagcaggtcatcaccacgaacaaagaaaggaaatgagtaatattcaatagcgttaatattaaaggcaaaaaaccaccatccaccgtagcctatttttctttcattatcaaaagtatctaaagaatctatttcccgagcatccagataatgtttatccgggtaatgtaaaaaatctctatgccatatggcaccagattcatgtatgattgccgggttatcttcaaaaagcatacagccagtaacaactgtatttttgtctttagccatcagtaaaaaagcatgagttcgacaaatcgattcaatttcacatgagccgtcgtcatccataaatatgacatgtttgacatcgttgattttccctgcctctatcaaacctctcataaacccgcctgacccaccgaggttttcattattgataactataatgccgtttcctgacgggtgattaatcgcctcgccattattaacgacaatcaatttaaaacgatctttaaattcgctctgggttaagagtgttttattaattaacagcttcttttctattataagttgttataactaaagccatagatgatttactaacatgatctttagtcagaaattaaaatccatttaaaacagagtcttcgtctgattgccactccacatagatatatccaaaatttatttttgatatatcaatctcaatctcaatctcaatctcaatctcatcactaatattacatgacgatttaaaatcaatttgctttaatactctaatgacaccattctctttatgccttacagttatagttccgcgaccaattatattaacccgcaaaaaaagtgatgttaaggttgtatattttttccatttcttaattgagaatgcattaaaaaaagtatcaaaatatgcaaccttatgacgcggaacaagtaagttacgtgaggtatagttatacttcccgccctgagttctgaaataaagctgctcttccgtgcatagatcaatgtttggtaaaattactttttgaagtaaaaaatacataacgaacctataaatttatattatctggggtaacgctattataaaatagtaaatttctcaccgcgtagtgatataaatactgcaataagaatattaaaatccacctttgctaactatctcactgtgctcaagcctgatgaacttattacatacagatttagccagttcatcatcatgagtggccattaccataatgcccgctttagagataaagctatttaatctcatctctgcttttcttttaaaatcactatcacccacgctcatccattcatccatcagtaaaatttcaggattaattgcagtagaaatagaaaaaccaagcctcagaaccataccactagaatacgttctaacggggattttaataaaatcacctaactcgctgaactcgatgacatcttctgtaatattttttatttcattttttgacagaccgagaaatagtcccctcagttttatattttccaggccggtaagctcaccatccattcccatcatgggatcaatgaggctggtgactcgaccaatacattcatacttccctgaagttggtttataggcccctgcaagtactctcagaagagttgttttgcccgaaccattgtgtccgataagcgcaagacggttaccttcggtaagcgtaaaatcaattttttttaatgcctctacttcaataatcccggtattcgatgagccaattcgtccacctgaagcagcctgtaaaaaagtttttttaaatgaacggtggctggagttaaatatagggagtattacgccaacgtttttgcaagagattttcattaattataaccagtatacgattcttgagcgatatttagtcaacactaaggttgagaccatcaacataataatagaggttattattgtgtaaaaccatatagttacatctggtacagttcccattaatggtttcctgagcatctccataaagtaataaaaaatattataatcaacaaattcctttcttccctttggtaattgttccgatgttcaaatgatgggagttataaaaaaacacaacgttactacactttgaacaaccggtcccatatcacgatatcttgtgcaaaaaatggcgagaatcatacctgtagaaattaatgagatggatgttattataattgcaggtataaaaaggagaatatcaagatttaccgatgtattggtaaaaaaaatcacgaaaggtataatgataaaattatgcaacataatcataaactgccgatagaaaacacgtaatatatataaatatagcggaaggtcagactgtttaataattgatgcggactcattaaatattccacatgattcattaatagttgctgatagaaaggcccaaaagatcatacctaaagtaagatgcatgataaaattttcggaaccagaactgaacagcgaaccgtaaagaggtcccattgctgatatggtgactcccatcgaaatcgttatccaaaaaggccctaacaccgatcgccggtatcgtcccaggacatcattccaacctagcgaaatccaaagttggtgcttggccagagcttctttcaaatcattcattgtttccgtgtcacctttacctgaagaacttattctttaacgatatgaaaatataacttatttattttctataatatttacatactatttatctaaacactgacctacttcataagcattttatggtgttagcaaccaatagtgtctttataaatttgcaatgtcttattaatgactaatatgctggaaaacaattcctttacacgttttcttccattcgcccccatctctaagcgaatctgtggattttttaacaaatactctaattctaccgctaactcctgagctgaattacttttcacgatcaacccattatagttatgaataattaagctatcacatccgccggtatcataagcaatacatgcacgtcctacagatgatgcctctaataaaagccgtggtactccttccggataaatagatggcaatgcaacgatattcgatttctgaataagctcatatacattcgaagagcgtcccagccagttaattagtccttcattatgccagtgatgaatgagctccaaagggatagcatctttatcgtcctcggccaatatacctgcaacatttaaaacaaaatgaatatttttttgtctgaggatcttttttgcttcaatgagatcgccaagacctttactccataacattcggcttgcaaaaaggactatcggtatctcatgttttttctctatagagaatttataaatatccgggttaattccagcaccttcgataacgatagttttatgataatcaatacctactaaacgcgatatttttcgtcgatctttatcatgttcaaaaataaaaacaccacgcttattaccggcaatatatttgtaaaccaaaacggttaacgcacgcaatattctcattggcacggtattatataaaaagattcgaccaagtccgacaaagctgataacaactggactattacttcttctggcgctaactccaccaatcaggcaaggtttgagcgtaatacaatgcaataagtcaggattaatctccttaataattttccgagcgttaaggaatgctctaaaaaaaacaaacatattaaatgactgagcaacaagagacacattgtgacaaataaaaccaagcgttttgaatttttttataatctcttcaccaataaaatgacttatgatatgaatttcataacccgcatcccttgccgctatcgcacgttctgtccagtgtaaatcaaagtaccagtctgaattcacaaaataacataaccttttcatctcttcgtcctgctaatgatatttcccactaatacctttaagtccatgaagtattccctgccagataaaatatagataacgaaatttcttacgctgccatggtaatatggcgagatatttagagaggcgtaatactatagaaagaacactgaatatcctgggaacgggtaaaagttttctcagcagcaacaaatttctacaaagataatatactttccattcggggcagatacaccttccatgaatagagatatcatgaataaatttaatttctggggagtaacgaattttctgcccggacaatactagcttataaccaaagaaaaaatcatcataataaaggaaaagttcatcatagatatcgttaagatggttattcaatacctttcgatcaataatcataccaacgaatgacacagtttgaacatcagtaacctgagttcttactggagaaaacctctctgggcgcatcgcataataaatagtctcaaacaccgtagatgggaccctaatgaaaggcaaattcatccgacaagaccgcccataggtgtcctgaactcgcgacgcaaatatacggtaacttgatgtatctaataacgagaaatgctttaaaatattaatttccgggtaagcatcatcatcataaaaaaatacccaatcggcattactatatgagcatatatattgactacctactttaaatccgccagcaccaccaagattatctttaagattaagtatcgtgatgccaggttcacttaatgaagaaagccattccctggtaccgtcgcttgagccattattaacgataacaatagaggaaaaacccgccttaacagtctctcgcacacttttttttaatttttcaagacgattaaaagttacgattagcgctgtacacttcatcaaacggtaactgtaaaagctggcatttctttttgttcatatagcgacgttaagtatacgtccgccgtctgtaatgcttcagctatcgtgatgtccatatcgagataacgataagtgccaagacgaccaatgaaagtaatattttttcttttttagcccgcgacagatatttattcagtaaatccattttatctgccctgcgaacaggatagtagggtatatcaccagcttcacattcccgactatattcttgataacatattgaagcttcatgtctctcccacggagaaaaatatttgtgctcagtaatccgagtataaggagtatctattgaacaataattcattactgcgcatccttgataatcactctggcaaattatttttttaaagtctaatgtacgatattccagtcggccatattgacaggagtaaaaggcatccagcgcgccactgaaaaaaacatgatcataatttgtccgcatttcttgagtgaaggagcgacatagttcaacagcgatattttcgtgttcgacaatggacttgaccatttgtgtataaccaaattttggtattccctgaaacttatgattgaaatagttatcatcataattaaaacgaacagggatacgtttcaatacagaagcgggtaacgcggaaggatgaagcccccattgtttaatggtataacctttaaaaaaggcttcatataactctttaccaatgaaacgcaaggcctgttgctcaaaattttgtggttccagaatggtgctatcacatttttgaagcagtaatttcctggcgtcatcaggtgagcaggcgacaccaaaaaattgattgatggtatgaagattgataggtagagaaaatacctgaccatttactgtggccttaaccttattgatataaggcatcatctcagcgtatttatttacataattccatacagtttcattatcagtatgaaaaatatgaggaccataaacgtacaccataatacccgtgtgctcatctcgggcatcataagcgttactaccgatatgcgaacgttgatcaataatattgactacatgtccctgctcggctaactggcgtgctattactgcgcctgaaaggcccgcacctacaattagtatctttttacgttgcattatttttgtcactctgttcgcagacacagataatattagatagtttatccagaaccattttcatttatatcagaagagtaaagtgaaatttactcaacgcatccagataattccacgctaccgccacagcgcgtaaaccctcgcactgattacagattcattaatgttacacgttatgcggtatttccggacaacgatgattgccatatttattttgtgaagataactcattcagaacgcaacattatgggtctgaataccgcgcggcatgatgtaaatatgctgtcagcataaatccggtgcgttaccggccccagtttttaccaacccactctgttgactgatgtccggaccgacgtccggtatccttattcttaccgcatcagatagcggtactcctgtcgggatatcccagcgttgtttcagcgtctgctccgcgagccagacctgcctcacgccggttcccagcatacgggccgtcatttccgggctacagcctgacaacagtaatcccagcacccgccgtccctgttttggcagacgctctgacagtaacctgaccagcgtgcggctgtttatctccatcaccagctccggcacgctcaacgcgcttttcatctcctcctcgtaaggcgatgtctgtagtgatgaccatatggcaagctcagccattctggccagaacccttaccgacatggcgcgtttaatcagcctcagatggcggaagtaaccttccacgctgacgtcaaccggtaaaaacgcgttactgctgcaaaaaaccactgtccgcggataacgcagaaaaacctgttgccacagcagaagctgggttgatggccgtccggcggatatcaccatcgcgccgggccaccgacgcaaccgatccagcagcccttctggtgtcctgagacgaacgcagtcctccacgcaaaggccgccggtatccggaaactgcgtaggattttcgcctgactgacaaaacataatcagccggagaggcggcagtactctggttaacgtctgcatatcagtacgtcagaacctggtacaggctgaacaacgctgcgacggtggagaccgccagcaggagcaaaaatatttttgcgcccatactgtaccggcacttactggtccccccccttccggtggacatttccgcatattcttgcgtcatcagattgttctcctctggccattgccgacccggcactgcgccagcaacggcagcttcgtgttgtggaaacaacatgtccgcaccctttcgtggaccgggagccattccatgtctgtatgaaaaatgacgtctggccccatctaaacactgctctctgacaccctgtccggttctgcttttcggctgcacaggccgtcagtccccctggtagtacatgctcctgccgtagggtaattctgccctgtgcggagtacaaaatgacaaatagaaaatacagtaatctattgatttatatgttgattatgtaaatcagctttccctgaacagacttctctgtgatttaacaatatgaatcagaacgtacggttatactcgacgtttttttcgccatattccatgaaaacgcccggcgttacttgcggtgtatcttacggtgtgctggatattcctgtgccccagatagtcctgtatgagtcgtgtatcaatccctttatcagcaagggcgtagccgcaggcatgtcgcagcatatgaggatgtggcgctatcgttaattcggccaaccgccctgcctcacgaagtatgtaaaaaaattgttgcctgctgagcggatgccgtcgtagcgacaggaacagccagtctccgtcagcccctttctcaagatacttcctggccctgagccagcttttcagtacgttatactcatcgggaaggagggggtgacacgttgaaaagccatttttgaggcgccggatataaagctgtcttcctgcaagatcaatatccgacaagcgcagccccagcagctcactggcccggaagccgtgaataaacgccatcaggattaagcagcggtttctttccgggaagggcattctgtcggtcgctgacagcagtttttcaatctcttcttgcgtaagatattttcttttcacaaaacaaatccatcataacaaaatgagtaatatactaaaaaatcactgatcagatgagtttaattttcgctaaaaaagttgctatgcgtaaacagcttaaaatccatatagctggcaatctggcacgctatccatgacgtgatagtgaaacagcgaatcaatctggcttcaatctcctgataagttgtcatgacgaggaatataaatgctaaaaatgaggctatcgtgaggtaaatcaatcagaaaggggtaatagagagtcaggtagtttacccgccccggaggtttgattagatggcgatagctaacaatatcatagtgattttcaaaaactctgctgctaacagcaataagctcatcatactggctattacagcatcacttggttatttttaaaataatatattataaggggatttatatagtattgaataaatccctcttcctgacattaagagaacagaacacgataatttttagcagccgtaatataatagcttcaatcgtcgggctctcaggcaataacgtgtacattacgcgcattgaacgcggcgcgtagcctgcgtgcgaatgcaagcgcatactcgccgtcgccatgaatgcacaccgtttgcgccgtgacagtcgtccacacgccagtaacgcttttcactctcccggcttgtaccatatccagcgtttgcgccagcgcctgctcttcgtcgtgaatcagcgcgccaggttgcatgcgcggcaccaggctaccgtcggcctgatagccgcgatcggcaaacacctcctgccgcgtcaccaggcgatggcgttcaccggcccggatcagctcacttcccgccagtccaaccagtatcagtgacggatcatagtcgtgtaccgctttcgcaatcgcctgtgccagatggggatctttcgccgcctggttatagagcataccgtgcggtttgacatggcgcatcacgccgccttgcgcctggacaatcgcccccagcgcgccgatttggtacagcgtctgggcgtataccgtttccggcggcaaaaccatcgccgtccgcccaaaattatcccgatccggaaagctgggatgcgcgccgatcgccacgccgtttttcagcgcctcgcgcacgcaggtcagcatggtttgcgcatcaccggcgtgaaaaccacaggcgatattagcggaggagaccagcgttaataattcgctgtcgctggcgcaaccttcgcccaaatccgcatttaaatcaatgttcatgctgaagtcgccaggtaagctgttccagatagcgccgacgctcgcggcgcgcgttgagcgcctcctccagcgaacattgcacaaaatggatcggttgttctagcgggatctgcgccagatggtacatatctgcctcgatgatgcaggcaatgcgcggatagccgccagttgtctgggcatcattcattaacacaataggttggccgttgtaaggcacctgcacgacaccgggcagcaaaccgtgcgacagcagttcgcgatccgttgtccgcgttaacgattgtccctgcaaacgatagcccatgcgattactttgcggactgagctgccacggcgaacgccagaacgcttcttgcgaggcgcgatcgaactcacggtattccggccccggtagcgcacggatgcgattcccccacagtaactgcttcacgccctgcggcccgctaagctgtcgcgatggtttacccgtcgccagccgatcgccatcttttagcagccgtccttccagcccaccgatgccggacttcagatcggtactacacgatcccatcacctccggcacagcaataccgcccgccaccgccagatagctacgcatcccgtgaagcggtcgatgcagcgtaagacgctgacccgcttttaccggcaatcgccagccggtccagaccggttgatcatccaactgcgcctcgcagcctgcgccggtaagagcgaaccaggtctcattttcaaattcgacaaccagttgaccgagagtgatttccagcgccggggcattcgcatcgttcccgaccaggagattagcggtctgaaaggcgggtttatccagcgcaccgcagtgactcagccccgactgacgaaagccgtgacgcccgctatcctgcacggaggtgtaaatccccgcgcgaataatattcagcatattccctccttttgcggcacaaagcgtacgctatcgccagggcgtagcagaaccggggtctcccgcatcggatcgaataacttcaacggcgtgaggccgatcagctgccagccgcccggcgtggataatggataaatccccgtctgcgcgccgccgatgccgacagaaccggccggaacctgcaggcgcggctctgcgcgtctgggcatatggagcggttctggtaaattcccaagatagggaaagccgggctgaaagcctaaaaaccagacgacatactcaacggaggcatgtagctccacgacctgcttttcactcaaaccgctgtgccgtgccaccgccgccagatccggcccgcctgcgccgccatagatcaccgggatctcaaccgaacgcgagtccggttccagcgcctcgctctcttcccaccagcgctgcagacgctcaatcgcatccagcgccagagtttgcggttcccgcaagatcacggtgatattgttcatcccgggaatggcttccaccacgttcggcatatcgaccagacgctgcgtcagacgccagatgcgtttctggctcgccagcgtaatcggcggttcaagttccaggacgaccgccgtttcgcctaacagataacaacgcgctcgctgcactttattacctctcagttatgccgggttagggatatcaataaacgtcacatccaacgccgtgttttcgttcaaccattcgctcagggcgcgaataccgccgcgttcagtggcatggtgcccggcggcataaaaatgcagcccctgttcgcgtgcggaatgaatggtctgttcagacacctcgccggtaataaaagcatccacgccgaagcgggcggcgctatcaataaaactttgtccgccgccggtacaccaggcgacacgctgcacattctctggcccggtatcgccgcaccatagcggtttacgccccagacgcgcttcaatccatgaggccagttccagccccggcaccggcattgagagctctccccacggcaccagcggctcaatttctcctttcacggtaatgcccaatagcgccgccaactgcgcattgttgcccagctcagggtgcgcatccagcggcagatgccaaccgtaaaggttaatatcatttgccagtaacgtttttaagcgacggcgtttcatgccgcgaataaccggagactcgcctttccagaagtaaccatgatgaacaatgaccgcatcggcctgcaaacgcaccgcctcatcgagcagcgcctgacttgcggtcacgccggtaacgattttctgtaccgtctcttttccttcgacctgtaaaccattcggcgcataatcgcttattgccgcactgttcagcttgtcgttaatcagttgttccagctcggtgtttttcatcatcgctccctttaacccacgttctactttcccgttacgggttcagtctccgttaacatagcctcccgttagccgttcgtcgataaacatttgtttgacacatcaagaaacaatcacccccgggtttggcgcaaattacttagcaaaacacgatcggtttcatgtatatttatgcaatcagaacgcatattgcagaaaaaatcagttctgtatcatgttggtaactttaaggaaacacggcgatacggcaggcttaataagcccacaaagaaaggcattatctgagaatgccgcgttcttgccgcagcgtctctatcccggaaatacgatgaataaacaagcatctcaaccccgcgctatttactacgttgtcgccctgcaaatttgggagtacttcagcttttatggtatgcgcgccctactgattctttatctcaccaatcagctaaaatacgacgataaccacgcctatgagttattcagcgcttattgttcgctggtctacgtaacgccaattctcggcggctatctggcggataaggtgcttggcaaccgaatggcagtcatgctgggcgcatttttaatggctataggtcatttagtgctgggcgccagtgagatcgcgccgacattcctttatctgtcgctggcgatcattgtctgcggctacggcctgtttaaatcgaatattagctgcctgctgggcgaactgtaccagccggaagatccgcgccgcgacggcgggttctcgctgctttacgcagcgggcaatattggttcgatcgtggcgcctatcgcctgcggctatgtgcaagaggagtacagttgggcgatgggctttgcgctcgccgccattggtatgctggcggggctggtgatcttcctgtgtggaaatcgtcatttcacccacactaccggcgtgaataaagccgtgttgtgcgccagaaactacctgctgccgaactggggctggctgttaattctgctggtagcggcgccgttgctgattaccgttctgttctggaaagaatggtctgtctatgccttaatcgtggcgaccgcgatcggcctggtcgtgctggcaaaaatttatcgtcaggcgcaaacggccaaacaacgcaaagaactggggctgattgtcaccctgaccctgttcagtatgctgttctgggcgtttgcccagcagggcggcagttctatcagcctgtatatcgaccgctttgtgaaccgcgatattctgggctattccgttcctaccgccatgttccagtcggtgaacgcctttgccgtgatgctgtgtggggtcgtcctggcctggctggttaaagagagcgtaagcggtaatcgcaccgtgcgtatctggggcaaattcgcgctgggtctcggtctgatgagcgccggattctgtattctgaccctgagcgcacgctggtccgccgcttacggacactcttcaatgccgctaatggtgctgggactggcggtgatgggctttgccgagctgtttatcgacccggtcgccatgtcgcaaattacgcgcattgatatccccggcgtcaccggcgtattaaccggaatttatatgctgctgtccggcgcgatagctaactatctggcaggcgtcatcgctgaccagacctcgcaaagcgccttcgacgccagcggcgcggttaattacgccatcaacgcctatgtggatgtttttgaacagatcacctggggcgcgttagcctgcgtaggggttgtcctgctgatttggctgtatcagtccttcaaattcaaaagccgcgcgctggccgtcgaatcctgatagcagaaggcccggtagtttgcgctaccgggcctgtatcacgccccttttctcgccgcctcataggcggaaagcgttgcgattctcgcctgtttgtgctccacaataggccgaggataatcaagtacgactcccgctttttccgcccaccgccacggctcgtgaatcgcttttccaggtatatcgcgtaatgccggtagccactggcggataaattcgccgtcgcgatcgaacctctctctctgagtcgtgggattaaaaatacgaaaataaggcgcggcatcggtaccggttgaagcggcccactgccagccgccattattggcggcaagatcgccgtcaataagctgcgacatgaaatagcgctcccccaaccgccagtcaattagcagatcttttaccagaaagctggcggtaatcatgcgtaaacggttatgcatccagcccgtcgcgttaagctggcgcatcgccgcatcgacaatgggataaccggtttcgcctttctgccatgcctgaaaatagtgcgggttctcctgccacgcgacgcgttttgtccagcggataaacggctggtgtttgcataatgccggataccaggtcattaaatgacggtaaaattcccgccagatgagctcattcaaccagacgcttcccggcccgccgtccagcgcctgcggctgctccgccagtaatcggtgcaggcactgtcgcggcgacaggccacccgtcgccaggctggcggaaagccgactggtgccgtcaaccgcagggaaatcgcgccgtgacgcatactcgtctgcgccctgcgagcaaaaatgacgtagctgcgcgatgaccgcgttttcttccaccgggaaaagcgcggcgtcaaacgcctgttgcgggtagttaagcgagactggcgttaagggtatagaaagcgcgccgctcacccggatcttcggggccggaacgcacggcgggatatcctcttttagccgtttcaaccaggcgtttttaaacggcgtaaaaactttatacatttcatgattgccggtcatcaccgcgccgggcgccagaatcacgctatcgtcaaagccttcgcagatgacagatggcagcgttttttccaccgccgcatcacgctgacgctcgttaaactcatactgatagttataaaacagatggctgacgtcatgctgccggcaaacgtttttaaccgtctcaatactggcgttaaaatccgccacttcatgaaacagcagcggaatccctttctctgcaagggccgtctgtagcgcattgagctgcgcgctgatgaatgccgcctgccgcggcgccatatcatgggcctgccactgggcgggggtggaaatataaagcgccagcacccgcgcggatgcatcgcggcaggcggcggccagcgcaaggttatcctgtaaacgcagatcgcgcctgaaccagactaaatgggtgggcatacaactcctgaaagatgaaacgtcacggcgaatagcgttaaacagtgtagaccctggcgcataaaaaaaccgccagcgtggcggctgacggtttttcaggctggtcgcgattaataaaagtcgcaggtggctttttcagcctgcgccatccataccggtttatcactggttttcgaccagacacggtgcagataactataaaaacgcgcgcggtctttccagaagagcatcaccggcaacgccagcacgcctgcggtcaccgcgaaagcacgacgtgcaaaaatgacatgcgctggatagtctttatagtgttccatacgtttcccccctttataccgacgctatccgccccggtatagattgaatcggtgaatagcaccgaaaaattgaacctcgttacctgattaaaatagtaccgctttcggtgtaatttcactactcatccgaccacttattttcacgcttttccagcagatttacattcaaagcgtaaattagttacaaaaaggttaaattaatactaatcattagttaaataatggtctttgccatttttatactttttttacactccgcccgccaatttttgcgaaatctttgcagccaaaaaattacctttctcaggagtaaaacaatgccactggaggtgctctgtgagtgcaggcgtgataaccggcatcgtgctggttttcttacttttaggttatctggtctatgccctgattaatgcggaggcgttctgatggccgcgcaaggatttttactgatcgccagttttttactgattttattggtactggcgaaaccgttgggttcgggcctggcaaggctcatcgccgccgttccgttgccgggcgtggctggcgttgagcgtatcctctggcggactcttggcattaccgaccacgaaatgaactggcgtcagtatttactggcgctactgacgctcaatctgctgggactgggcatcctgttttgcctgctattctggcaggagtggctgcccttaaatccgcagcggctaccggggctgtcctgggatctggcgctgaataccgccgtcagctttgtcaccaataccaactggcaagcctacagcggcgaaagcacgctgagctactttagccagatggcggggctgacggtgcaaaatttcctgtcggcggcgaccgggattgcggtggtttttgcacttatccgcgcctttacgcgccagaatgtgcacacgctgggtaatgcctggcaggatctggtacgcattacgctatggatattatttcctgtcgcgttaattatcgcgctgttttttatccaacagggcgtaccgcaaaacctgtcggcttatcagcccatcaccactcttgaaggcgctaaacaactcttgccgatggggccggttgcttcgcaggaggcgatcaaaatgcttggcaccaacggcggaggtttctttaacgccaactcttcgcatccgttcgaaaatcccaccgcgctcactaatctggcgcagatgctggcgatatttttgattccagccgcgctctgtttcgcctttggcgaagcggcgggcgatcgccgtcagggacgcgccctactgtgggcaatgtcattcatttttgtggtctgcgtagcggtagtgatgtgggcggaagttcagggaaatccacatctgttggcggcaggcgcggacagtagcgtcaacatggaaggtaaagaggcacgctttggcgtgctggccagcagcctgtttgccgtcgtcacgaccgcggcgtcctgcggggcggtaaatgccatgcacgactcgtttaccgctctgggcggtatggtgccgatgtggctgatgcaaattggcgaagtggtctttggcggcgtcggttcagggctgtacggcatgttgctgtttgtcctgttggcggtgtttatcgcggggctgatgatcggtcgcacgccggagtatctggggaaaaaaatcgacgtgcgcgaaatgaaaatgaccgcgctggcgattctggtcacgccgatgctggtcttgttgggttcggcgctggcgatgatgacggatgccggacgcagcgcaatgctgaaccctggcccgcacggttttagcgaagtgctatatgccgtctcctctgccgccaacaacaacggtagcgcctttgcaggtctgagcgctaactcgcctttctggaactgtttgctggcgttctgcatgttcgtcggacgtttcggcgtgattattcctgtcatggccatcgccggatcgctggtcagtaaaaaagtacagccggccagtcagggaacgctggcgacccacggcgcgctatttattggactgctcattggcacggtactgctggtcggcgcgctgacgtttattcctgccctggcgcttgacccggtagcggaacatttctctttaccttgagcgatgcggagtacattgatatgagtcgcaagcaactggcgctgtttgaacctgttttactcgtacaggcgctaacggatgccgtaaaaaaattaagcccacgcgcccagtggcgtaacccggtgatgtttgtggtctgggccggcagcgtgctagccactctgttaacgctcgctatggtaacaggacaaatagcgggaagcgccttgtttacaggggtgatcagcctgtggttatggttcaccgtactgttcgccaattttgccgaagcactggcggaaggccgcagcaaagcccaggcaaacagtctgaaaggggtgaaaaagaccgcgttcgctcgccgtctgcgcgccccgcgccatgatgcgcaggccgataacgtgcccgccgctgaactgcggaaaggcgacattgtcctggtcaaagcgggcgatattattccctgcgacggcgaggtcatcgaaggcggcgcctcggtggatgaaagtgcgattaccggcgaatccgcgcccgtgatccgcgagtccggcggcgatttcgcctctgtcaccggcggccgcgccgtagaagccgcgggcgatgtcgacgtgttactgctggataaaaccggcactatcacgctcggcaaccgccaggcgtccgattttatacccgcccgaggggtggacgaacgcacgctggctgacgccgcgcagctcgcttcgctggccgacgaaacgccggaaggccgcagcattgtgatcctcgccaaacagcgctttaacctgcgtgaacgcgatgtgcagtcgcttcatgccacctttgttccgtttaccgcgcaaagccgcatgagcgggattaatatcgataaccggatgatccgtaaaggctcggtggacgcgattcggcgtcatgtcgagagcaatggcggccattttcccgccgatgtcgagcaaaacgtcgagaacgtggcgcgtctgggcgcgacgccgctggtggtcgtggaaggcgcgcgcgtactgggtgttatcgccctcaaggatatcgttaaaggcggcattaaagaacgtttcgcccagctacgaaagatgggcattaaaacggtgatgatcactggcgataaccgcctgacggcggcagcgattgccgccgaagccggtgtggacgattttcttgccgaagccacgccggaagccaagctggcgttgatccgtcaatatcaggcggaaggacggctggtcgccatgaccggcgacggcactaacgatgccccggcgctggcgcaggctgacgtcgcggtggcgatgaactccggcacccaggcggcgaaagaagccggtaatatggtggatctggactctaacccgaccaagttgattgaagtggtgcatatcggtaagcagatgctgatgacgcgcggctcgctcaccaccttcagtatcgcgaatgatgtagcgaaatatttcgccattattcccgccgcgtttgccgctacctatccgcagctaaacgcgctcaacgtgatggggctgcattcgccgaactccgccattctgagcgcggtgatctttaacgccctgattatcatatttctgatcccgctggcattaaaaggcgtgagttataagccgctttccgcatcggccatgctgcgccgtaatttatggatctatggtctgggtggtctggtggtgccgtttattggcatcaaagtgattgatgtgctgctgaccctgctggatctggcgtgaggtgtatgatgatcggtttacgtcctgctttttcgacaatgttatttctgctgttattgaccggcggcgtgtatccgcttctgaccacggcgctggggcagtggtggtttccctggcaggctaatggctcgctgattcataaagacaatctgatacgcggctcagcgcttatcggacaatcgtttaccgccgcgggctattttcatggccggccctccgccaccgccgatacgccttataatccactggcgtcgggcggaagcaacctggccgccagcaatcccgaactggatgcgcaaattcaggcccgcgtcgccgcgctacgcgccgctaacccccaggcgagttccgcggttccggttgagctgacgacggcgtcggcaagcgggctggataataatctgacgcccggcgccgcggcatggcaaatcccccgcgtggcggcggctcgccagcttcccgttgaacaggtcgcgcaactggttgcagaatatacgcacaggccgctggcgagctttcttgggcaaccagtggtgaatattgttgagcttaatctggcgctggatgcgctacagggacacagagcgaaatgaacgacgaacccttgcgtcctgatccggatcgcttgttggaacaaacgcccccgccccaccgggggaagttaaaaattttcttcggcgcctgcgcaggcgtcggaaaaacctgggcgatgctggcgcaagcgcagcggctgcgagcgcaggggctggatgtggtgatcggcgtggtagagacgcacggccgtaaagagaccgccgcgctacttgacgggctgaccattctgccgccaaaacgtcactcgcaccgggggcggcaaattcgcgaatttgacctggatgccgccctcgcccggcgtccggcgctgattttaatggatgagctggcgcacagtaacgcgcctggctcacgccatcctaagcgctggcaggatattgaagagctgctggaagcgggaatcgacgttttcaccaccgtgaacgtacaacatctggaaagtctgaatgatgtggtgagcggcgtcacggggattcaggtgcgcgagaccgtccccgatcccttttttgatgccgctgatgaagtcgtactggtcgatctgccgcccgacgatctgcgccaacggctcaacgaaggtaaagtgtatatcgccggtcaggcggaacgcgctattgaacattttttccgcaagggcaatctgatcgccctccgcgagctggcgctacgccggacagccgatcgcgtggacgatcagatgcgcgcctggcgcgcgcatccgggcgaagaaaaagtatggcatacccgcgatgcgattttactgtgtatcgggcataacactggcagcgaaaaactggtgcgtaccgcggcgcgtctggcctcccggctcggcagcgtctggcacgccgtctatgtcgaaacgccaacgttacaccgcttaccggaaaaacaacggcgggctattttaagcgcgctgcgcctggcgcaggagcttggcgcggaaaccgccaccctgtccgatcccgccgaagagaaagcggtcgtgcgctatgcccgcgagcataatctggggaaaatcgtcatgggccgcccggcgtcgcgacgctggtggcgacgtgacgctttcgccgaccgtcttgccaggcgcgcgccggatctcgatcaggtaatcgtcgcgctggaagagccgccagcgcgcgcgttggcgcaaacgcctgataaccgaccttttaaagagaaatggcgtggacagattcagggctgtctggtcgccgtggcgctttgcgccataaccacgtttatcgctatgcagtggcttgtcaccttcgacgccgccaatctggtgatgctctatttgctgggcgtagtggtgattgcgctgctttacggacgctggccgtcggtggtggcgacggtgattaacgtggcgagtttcgatctcttttttatcgcaccacgcggtacgctcgccgtttcggacgtgcagtatttgctgacctttgccgtgatgctgacggttggtctggtgattggcaatcttactgccggggtgcgctatcaggcgcgcgtcgcccgttatcgggaacagcgtacccgccatttatatgaaatgtctaaagcgctggccgtcgggcgtagcgaacatgatatcgccgcgaccagcgagcggtttatcgcctcgacgtttcaggcgcgcagccaaattttattacctgatactaacggtaagttgctgcctctcacccaccagcaaggcatgacgccgtgggacgacgcaattgcgcgctggagttttgataaaggccagcctgccggcgcaggcaccgatacccttcctggcgtgccttatcaaatcctgccgctgaaaagcgccgataaaacgtacggtctggctatcgtcgaaccgggtaatttgcgtcagttaatggtgccggagcagcaacgcctgctggaaacattcactctgcttgtcgccaacgcgctggaacgactgacgctgaccgccagcgaagaacaggcgcgtctcgccagcgagcgcgaaagtattcgcaacgctctgctggcggctctgtcgcatgatttacgcacgccgctgacggtattgttcggccaggcggaaattttgacgctggatttagccagcgcaggatcgccccacgcgcgtcaggccagtgaaatccgccagcatattctcaacaccacccggctggtgaataatttgctggatatggcgcgtattcagtccggcgggtttaatcttaaaaaagagtggctgacgctggaagaggtcgtcggtagcgcgttacagatgttagagccgggtttattgcatccgattacattgtcgctgccgcaacagttaacgcttatccatgtcgatggccccttatttgagcgtgtcctgatcaacttgctggaaaacgccgttaagtacgccgggccgcaggccagtatcggcattgatgctgcggttaaggacaatcgtttacaactggatgtctgggataatgggccgggtattcctgcggggcaagaacagaagattttcgataagttcgcccgcggcaacaaagagtccgccgtccccggcgtggggctggggctggcgatttgccatgctatcgtagaggtacacggcggcacgcttaccgcctataatcgaccgcagggcggcgcctgtttccgtgtgacgctgccgcaaggaaagccacctgaacttgacgattttcatgaggatatgtgacaaacgttctgattgttgaagatgaacaggccatccgccgctttctgcgcgccgcgctggaaggcgacggcctgcgcgtgtatgaagctgaaacattacaacgtggtttactggaagccgccacgcgaaagcccgatctgattattctcgatctcggcctgccggacggcgacggaatcgattttattcgcgacctgcgtcagtggagcgcaataccggtgattgtcctttccgcccgcagcgaagaaagcgataagattgccgcgcttgacgccggagctgatgattacctgagcaagccattcggcattggcgagttgcaggcgcgtttgcgtgtcgcgctgcgacggcacgccgccagcccttgcgccgatccgatcgtccgcttttccggcgtgacggtcgatctcgccgcacggttgatccaccgtggcgacgaagaaatccatctgacgccgattgagttccgcctgctggcggtattactcaataatgccggcaaggtattaacccaacggcagttattaaaccaggtctggggccctaacgccgtggagcatagccactatttgcgcatctatatgggacatttacgccagaaactggaacaagatcccacccgcccacgccattttattatcgaaaccggaattggctatcgctttatgccgtgaatagctattcattatttttaaataacttttaatttttatgtcatttattttcggcgtcgcgaataattattttcgcggcgatattatattttatggaggatataaaaaacatataattaacatttaagaaacaatccgttatttcacagcacgatatgcataatcgccgactaattatttttcaaatgatcgttttttgttgatctggttcacagattgctggcgctccctggataaaatatccatgctttcaataaatcaatgaaaggacctcaaaatggaaaataataatcgttttatgccccatataaggcggacaacgcatattatgatgtttgcccaccgtaatagtttcgactttcatttctttaatgcccggtattttttctgctacgggtacttcagcatacaggtctttccgacccttatgtcattcaggtctattgcctaaataactcgaattgttaaaagcgacagtacggtaattcctttacgcccagccagctaactatgtggtttgacagaagaaattccgactcagcgcaattttagttatcgcggtttctgcctgtatatcgtagtactcaactccttaaatcctgaatttcctgcaaccggacgggttgggatttattacatctaaaataaagctaatttactgatttttttatcagcgggatagctttgattttttccggaagaatcagtttctcatgcgagaaattgagggcctgctattacctgaaataaagagatgaaaaatgtcagaattaaaaattgccgttagccgtcattgcccggattgtttttctacacaccgtaatattgtaaatgttgatgagagtcgtttcatcgacgtggctgcatccgtgttatccatcgacgacattgaacacggaaaactcgatgaaatcgacgcaacgggttacggtattcccgtgtttgtcgcgactcatgacgaaggacgcgtaccgcctgagtatttgccgcgtatctctggtgtattcgaatataatgaatcccgtactgccttctatggtcgccagttggaaaccgcagcaagccactacgaaacgcagttacgtccgccgtttttccgcgcgctggtggattatgtcaaccagggcaacagcgcatttgactgcccggggcatcagggcggcgaaagtctttaacgccgataagacctactttgtgctgaacgggacctcctcctctaacaaagtcgtactcaacgcgctgttaacgccgggcgatctggtactgtttgaccataacaaccacaaatctaaccaccacggcgcattattgcaggcgggcgcaacgccagtttatctggaaaccgcgcgtaaccgtatggttttatcggcgggatcgacgctcactgcttcgaagaagattacctgcgcgagctgattagcgaagtcgcgccgcagcgtgcccacgaagcacgtccattccgtctggccgtcatccagttaggcacctacgacggtacttaggcacctacgacggtaccatttataacgcctgtcaggtcgtcgataaaattggtcatctgtgcgactacatcctgtttgactccgcctgggtcggctatgaacaatttattccgatgatggccgattgttcgccgctgctgctggaactgaacgaaaacgatccgggtattctggtgacgcagtccgttcacaaacaacaagccggtttctcccagacctcgcagatccataaaaaagatagccatatcaaagggcaatcgcgctacgttccgcataagcgcatgaacaacgcctttatgatgcacgcctccaccagcccgttctatccgctgttcgccgcgctggacgttaacgccaaaatgcacgaaggcgtcagcggtcgcaatatgtggatggattgcgtagttaacggcatcgatgcccgtaaattgatcctcgaaaactgtcaccacatccgtccgttcgtaccggaactgattgatggtaagccgtggcagtcatacccaacgtcagagatcgccagcgatctgcgcttcttccacttcgttccgggagaacactggcatgcgtttgaaggctatgccgaacatcagtactttgtcgacccttgcaaactgctgctcaccacaccgggcattaatgcagcgagcggcgaatatgaagactttggcgttcctgccacgatcctcgccaacttcctgcgcgagaacggcgttgtgccggaaaaatgcgacctcaactccattctgttcctgctgacgccggcagaagacatggcgaagttacaacagcttgtcgctctgctggctcgtttcgaaaaactgctggaagctgatgcgccgttagcggaagtattaccgtccatctacaaacagcatgaagcgcgttatgccggctataccctgcgtcagctttgccaggagatgcacgatctctatgcgcggcacaacgtgaaacagctgcaaaaagagatgttccgtaaatcgcatttcccgaaagtcagtatgaacccgcaagaggccaactatgcctatctgcgcggcgaggtcgaactggttcgcctgccggaagcggaaggtcgtatcgcggctgaaggcgctctgccttacccgccgggagtgctgtgtgtagttccgggtgaaatctggggcggttctgtcctgcgttacttcagcgccctggaagaagggatcaacctgctgccgggctttgcgcctgaactgcagggcgtttatatcgaagaacacgacggccgtaagcaggtctggtgctacgtcattaaacctcgtgacgcgcagcgctccctgctgaaggaggaaaaattatgagtaaacctaaatccaataaaatgggtgtcgtgcagctcacaattctgactatggtcaacatgatgggctccgggatcatcatgctaccgaccaaactgtctgaagtcggcacgatatccattatctcctggctggtcaccgccgtcggctcgatggcgctggcctgggcgtttgcgaaatgcggtatgtttagccgtaaatccggcggcatgggcggttacgccgaatatgccttcggtaaatccggcaactttatggcgaactatacctacggcgtctcgctgctgatcgccaacgtggctatcgccatctccgctgtcggctatggtaccgaactgttcggcgccgcgctgacgccgctccagatcggtctggcgactatcgccgtattgtgggtttgtaccatcgcaaactttggcggcgcgcgtattaccggacagatcagtagcgttaccgtttggggcgtcatcattccggttgtcggcctgtgcatcattggctggttctggtttagccccagcatgtacgtagcgtcatggaacccgcaccatgttccgttctttagcgcggtcggctcttccatcgccatgacgttgtgggcatttcttggactggaatccgcctgcgctaacgcagacgtggtcgagaatccggaaaagaacgtccccatcgcggtactgggcggtacgctgggcgcggcggtcatctatatcgtttcgactaacgtgattgccgggattgtgccgaacatggatctggcgaactccacggcgccgtttggtctggcgtttgcacagatgttcacgcctgcggtaggtaaagtgatcatggcgctgatggtaatgtcctgctgcggctcgctgctgggctggcagttcactatcgcccaggtctttaaatcctccgctgacgaaggctatttcccgaaagtcttctctcgtgtaacgaaagtcgacgcgccggtacaggggatgctgattattgtgattattcagactggcctgtcgctgatgaccattagcccgtcgctgaatagtcagtttaacgtcctggttaacctggcggtggtgacgaacattattccgtatattctgtcgatggccgcgctggttatcattcagaaaatggcgaatgtgccatcatcaaaagcgaaagtcgctaacttcgtggccttcgttggcgccatgtatagcttctacgcgctatattcctccggtgaagaagccatgctgtacggctcaattgtgaccttcctcggctggacgttatacggcctggtctcaccgcgttttgaattgaaaaataaacacggctgatggcgcgcccgggctgcggtaacgatagcccgggcattttcactctttgaataagataatagaaatgagtaatccagaacgggaagtcactgatatagcagaaatactggctattctcagtaaacacgaagtgtgtcggatagggtttaacgacaatctctgtccgtatgttgtccccgtaaattttggctacgagtatcagaacggacgctggatattttattttcacggcgcacgcaccgggaaaaagatgcgtctgttacgtaagaacccggcagtatgcattgaaatggacggcgaccatgcattactacgtgccgatgacccctgtgattatagctacgcctacaccagcgttttcgccaccggactggcatcgatattgcaaacgcgcgaggagatgcgccacggcctggacgtcattatgcgccagaccgatccgggaaaaaccttcagttatcgggaagatatgatgaaagcggtttgcgtggtgcgtatcgaatgcgacgccctcacctgccgccgacatctggcgactcagagcgaataagtcagatatcacaagcgccttatccggcctggaggcggtttacaggcctgataagcgcagcgccgttaatacaaaaaaggagccgtaaggctcctttttcttccatatcgcccatcaggcgtttttcaatacttcgctaacgatttcaacggcttctttctcaatctgcttgcgatgttcttcccccaggaagctttcgcaatagatcttgtaagcgtcttccgtaccggatggacgcgcggcgaaccagccgttgtcggtcattaccttcaggccgccaatcgatgcgccattacccggcgctgcggtaagacgcgcggtaatcgggtcgcctgccagcgtgctggcgctcaccatttccggagacagtttagacaatgccgctttctgggccgaggtcgctgccgcctgcagacggttatagctcggcgcgccaaaacgcgctgccagttcattgtaatgctcttgcgggtttttcccggtaacggcggtgatttccgccgccagcaggcacatgatgatcccgtctttatcggtagaccacggcgtaccgtcgaaacgcaggaacgaagcgcccgcgctctcttccccgccgaaaccaaagctgccgtcgaacaaaccgtcaacaaaccatttgaagccaaccggcacttctaccagcttgcgtcccaaatcattcaccacgcggtcaatcatcgcggaagagaccagcgttttaccgacagccacgtctttgccccacagcggacgatgctggaacagatagttaatggcgaccgccagataatggttcgggttcatcagccctgcaggcgtcacgatgccatgacggtcgtagtccgggtcgttggcgaaggccaggtcaaacttgtcacgcagcgccagcaaacccgccatcgcacattcggaggagcaatccatgcggatcgcgccatctttatcaaggtgcataaagcggaaggtttgatcaacctgatcgttgactaacgtcaggttaagcttgtaatgctcagcgatacgtttccagtattcaataccagagccgcccagcggatcaacgcccagcgtcagaccggctttctgaatcgccgccatatcaacgatatccgccagcccttcgacaaacggctgtaccagatctaccgctttaacgtgacccgaggccattgccgcatccagagagatgcgcttaacgccttgcaggccatccgccagcagcgcattggcgcgatcttctaccactttagtgacgttggtatccgccgggccgccattgggcggattatatttaataccgccatcttccggcgggttgtgcgacggtgtaatgacaataccatctgccagcgggccgccttttttgttatggaccaggatagcatttgacacggcaggcgttggcgtgaagccattattttcctgcacgataacgtctacgccgtttgccgccagcacttccagcacggaaatgaaggccggttccgagagcgcatgggtgtctttccccacatagcaggggccggtaatgccatttttcgcccgctcttcagcaatcgcctgggcgatcgccagaatatgcggttcgttgaaactgtgacgacctgcgctgccgcgatggccggaagtgccaaatttcacggcatgttctgcattccctgcctccggtttcagtacataatactgcgctgtcagttgggcgacgttaatcaaatcactctgttgcgcgggttgtcctgcgcggttgtggattgccattgcctggtccttctaatgcaaggattaaattgttccgcaaaccttttcaatcaattccgccgggaattgcattgactgcatgatgtgttcgatcatgctgcatttacggccggtgttggtgttggtgatcacccagtacggcgtgccgggaacgtgcttaggtttagtttgattcccatttttcagcagcgtttgttcatccgccgcaaaatagacgcgcgtgcggccatgcaacgactccgtcgcctccgcaaacgcgtggtgatccagtgaatagagtgtagtcagaatcagcataaagcggttgaccgcttttttctgctcggcatattcatcagacaacaacagctcacgcatcgcgcgaactttgtcttttaccgggttaaccggtttcgcttcggcaacgggttgcgccgcaggcgtccccttcaccgctgaagccgttggctgtgtcgtggcggaaaacttcaacatacgccgtaaaatgtcggatgcgctctcgccgatatgcttggtgtggctggcaatatagctatagagttcatcatcaacttcaatcgttttcatcttaatccagtgcgatgtctttgctgaatacaagtcattgggattataggaacaaatcccaacagcggatagcgttaagcccggctgacaaaaaaactcggagtaaaccttagaggttgcagcccagtggcagaatggtcaacataataccctaacccgacagagcgaaaaaaagaactttgccatgaaattaaacatccgagcgcaatctgcacaaaacctgcacaataattcccccatcgttctcgttcatggcctgtttggcagcctggacaacctcggcgtactggcgcgcgatctggtgaccgatcacgacattattcaggtcgatatgcgcaatcatggtttatcgccgcgcgatccggtcatggattatccggcaatggcccaggatcttctggatacgcttgacgcgcagcagattgaaaaagcgacgtttattggtcattccatgggtggaaaagcggtaatggcgctgacggcgctggcgcccgatcgcatcgatcgtctggtcgcgattgatatcgcccccgtggattatcacgttcgccgccacgatcgcattttcgcggccattaacgccgtcagcgaatccgacgcgacatcccgccaacaggcggcagggattatgcgccagcacctcaacaaagaaggcgtgatccagtttctgttaaaatcctgggctgaaggcgaatggcgttttaatgttccggtattatgggagcagtatccgcatatcgtcggctgggaaaccattccgccctgggaacatccggcgctgtttattccaggcggtaactcgccgtacgtgaccgaagcgtaccgcgacgcgctgctggcgcaattccctttggcgcgcgcgcatgtgatcgccggcgcgggccactgggtacatgccgaaaaaccagaggcggttctgcgcgccatccgccgttatctgcacgataaacgctaactgattaaaaactcatcgcctgtgcgcgattacgcgcgcgagcgttggcgtcgcttcctcgctgatgtatgatggcgcgctatccatccgggcataagcctggctgattgtttcccccgaagtcaccaaaatcatggccaaagaacaaacggaccgtacgacattagatctgttcgcgcacgagcgtcgcccgggacgacctaaaacgaatccgctttcgcgcgatgaacagttacgcatcaacaagcgcaaccagttaaaacgcgacaaagttcgtggcctcaagcgtgtcgaattaaaactcaacgcacaagcggttgacgcgctgaatgagctggccgaagcgcgcaacattagccgcagcgagctcattgaagaaatattaatgaagcagcttatggcgctgcgcggccagggtttagtctgaaaataagttttgtttcatatttcgtgtagcagagcgtgcagtcccgcgtgattgctgtttccgcatatctgcctgttctgctatgattgcccttatccgtgggcaattcgccaccaccatttcaataagtttcaagaggttattttactcatggcaatcactggcatctttttcggcagcgacaccggtaataccgaaaatatcgcaaaaatgattcaaaaacagcttggtaaagacgttgccgatgtgcatgacattgcaaaaagcagtaaagaagacctagaagggtatgacattctgctgctgggcatcccaacctggtactatggcgaagcgcaatgtgactgggatgacttcttcccgactctcgaagagattgactttaacggtaagctggtggcgctgtttggctgtggcgatcaggaagactacgcggaatacttctgtgatgcgctgggcacgattcgcgacattattgagccgcgcggcgccacgattgtgggtcactggccaaccgcaggctatcattttgaagcctctaaaggtctggctgacgacgatcattttgtcggcctggcgattgacgaagaccgtcagcctgaactgaccgccgagcgtgttgaaaaatgggttaagcaagtttcggctgaattgcacctcggcgacatcctcaacgcctaatcttatgcggcgcagcgttatatctgcgccgcatcaatagacaagaccaatcaaaataattgctacaaatttgtaactttcgcacccatccctgtacaatgtccgggtgtaatcaggtggcgccagaatttgcaggcaaaaccacagttttattaacatctgcgagagacttgcggttttcatttcggcatggcagtcctataatgatacgcattatcttgagtgcaatttctgtcacttctctaatgaagtgaatcgtttagcaacaggacagattccgcatgactgacaacaataccgcattaaagaaggctggcctgaaagtaacgcttcctcgtttaaaaattctggaagttcttcaggaaccagataaccatcacgtcagtgcggaagatttatacaaacgcctgatcgacatgggtgaagaaatcggtctggcaaccgtataccgtgtgctgaaccagtttgacgatgccggtatcgtgacccgccataactttgaaggcggtaaatccgtttttgaactgacgcaacagcatcatcacgaccatcttatctgccttgactgcggaaaagtgattgaatttagtgatgactctattgaagcgcgccagcgtgaaattgcggcgaaacacggtattcgtttaactaatcacagcctctatctttacggccactgcgctgaaggcgactgccgcgaagacgagcacgcgcacgatgacgcgactaaataagtgtaaatctttcgaagagccaaccgcccggttggcttttttatatcctcctctttcctgccgcttgatgttgatttaatgtaaaaaacgctatcgcatctcaggagagcaggaatggagcttcgccagttacgctatttcgtgcgtattattgaaaccggcagtatgggcagcgccgcacaggatcttgatattggcgtttcagcattgagtcaacagatgtcccgtctggaaaacgagctcgccatccgtctgctgcagcgcacctcgcgcggcgtaacgccaaccaacgccgggctggccttttattcacaggcgcaactcgccctgcgtcatgccgacgacgcgattctcgccgccagagaagcgcgcctttccggtcatgtgagcgtaggaatggcccccagtaccgcctccatactgggtataccgtttatccatgccatgcaggaaaactatgccgatgtccgactgcatgtggtggaaagcttgtccggtaatctggaaagaatgatcaatacccgccagattgatttagccgttgtctttcaaaaagataaaatcctgcgctggagcgccagaccgatccttgaagaacagctttttctgattggctcccatgccctgctggcggcgcttcctgataacccgatcacacctgaacaactggcaggcattccgctcattatgccaagccagggacatgggctgcgcggcaggctggacgctgtctgcaaggaacatgcgcttaatgttgaaatcgtcgcggaaattgacggcctggcgttgttgatgcgcgccgtgcgcgacggtcttggcgccacgttgcagcccggcgcggcgatttctcatctggataacgacgcgctacgcgtgatcggcgtccataatccggtactcagccgccccaattttttagtcagcctgtcggatgatgaactgacgcccgccggccttgccgccagagtagtccttaccaaagttatgcgtcagttagtcgacgccggtgaatggccaggcgcaaccctttacgcttactaaacccctgtttagcgctacctgatagcgcgccgcttatttatccgtatacatttcaattacaaatttaacaaatagttaaatggtacgggagtataagatggttgatgtactggtgataggcggaggcaatgccgcattatgcgccgccctgaccgcacgggaagcgggcgcatcggttctgctgctggaggctgccccgcgagaatggcgcggcggaaattctcagcacacacgaaacctgcgctgtatgcatgatgcgccgcaggatgtgctggtggaaagctatcctgaagaggaattctggcaggatctgtggcgagtcaccgacggcaacaccaacgaggcgctggcgcggctggtcattcgcacctcttcgcaatgccgcgactggatgcgcaaacatggcgttaactttcaaccgccactatctggggcgctccacgttgcgcgcaccaatgcgttttttatgggcggcgggaaagcgctcgtcaatgcctattaccgtagcgccgaacggctgggcgtacagattcgctataacacgccggttcacgcgcttgaacttcatgacggcgaattcgtggcggcgctggcgggtagcgaacgtattaccgccaaagcctgcgtattagcggctggcggtttcgaatcaaaccgtgaatggctgcgggaggcctggggagaaaacgcccgcggcgaatggcccgcggataatttcctgattcgcggcacgcgttttaaccagggcgtattactcaaatttatgatggatgccggcgcggatatcattggcgatccgtcccagtcgcactgcgtagcgattgatgccagggcgccgctgtacgacggcggtatttgtactcgcgtggattgcgtatcgctgggtattgtcgtgaatcgcgacgccgagcgtttttatgatgaaggcgaagatttctggccgaagcgttacgccatttgggggcggctggtggctcaacagccaggacaaattggctattcgattattgacagcaaagccattggccactttatgccgccggtttttcctggcgcgcaggccaatacgctggctgaactggcctgccagttggggctggacgcggaaaaatttacccataccgtcacgcagtataaccaggcctgccagcccggtcattttgatcataccttgcttgatgactgcgccaccaaaaacctgacgccggcgaaaacccactgggcgcgcccgcttgatgcgccgccctactacggttatgcgctgcgacccggcatcacgtttacctacctgggcctgaaagtcaatgaacgtgccgcggtgcattttgccggtcatccaagccgcaacctgtttgttgccggcgagatgatggcaggaaatgttctgggcaaggggtataccgcaggcgtaggcatgtctatcggcacaacctttggccgcattgcgggaatagaagccgctcgcgcggcgcacaaggaggcgcagcatgaaacagcttgaaaaattaatcattgaggccaccgtgcttaccgaaccggaagccgaggtcgaacgcgtcatgcaagtgtgtaacgcgtgtcgctactgcgaaggtttttgcgcggtatttccggcgatgacccagcggctcgaattcggtaaagccgatattcattatctggcgaatttatgtcataactgcggcgcctgcctgcacgcgtgccagtacgcgccgccccatgaatttgccattaacgtgccgaaagcgatggcgcaagcccgcctggagacgtatcaacagtatgcccagcccgccgcttttggcgcgttataccgtcgggcggggatcaccgtcgcgctggcgctgatagtcggtctgacgctctttttattactggcgatggcgctgaaagggtcgctgattcatccgccgctggccggtgacttctatcaaatttttccgcatagcctgctggcatggatgtttggctcagtttttgtgctggcaatcggtttgcttatggcgggcgtaatcagcttctggcgtgagatctcgccgggtgtaccgcgttcggcggagattgcggaagcgtcgcacaatgcgttaacgctgaaatatctcgacggcggtcacggcaaaggctgtaacgaagcggacgatgcgttcacgctgctgcgccgtcgctttcatcactttaccttttacggttttatgctctgttttgccgccacggtcgtggcgacgggctatcactacgtcgccggttgggaagcgccctacccgttctttagcctgccggtcatgctcggcacgctgggcggtatcggtctgcttatcggcccggccgggctactgtggctcaatctgcggcggtcgccgttacatagcgatgcgcgccagaaacccatggatcgcggctttattctgctgctgttcttaaccagtcttaccgggctggcgctgctggcaggcagagacaccagcggaatgggcatactgctggcgctccatttaggcgtggtgatggcgctctttctcacccttccctacggaaaattcgcccacggatttttccgctgcgcggccttactcaaatgggcagttgagaagcgacgcggaaaacatgcgggggatacaggcaactgacccgcaacatcttacctataaaacaataaagacagtggagagcaaaccctatggcacaacacacacctgcaacatcgcgcgccggcacgttcggcgcaatactgcgcgtgacaagcggcaatttccttgaacagtttgattttttcttgttcggattttacgccacctatatcgccagaacgttttttccggcggaaagcgaatttgcctcattaatgttgacctttgccgtctttggctccggttttttaatgcgccccgtcggcgcgattgtgcttggcgcctatattgacagaatcggacgtcgtaaagggctgatggtgacgctggcgattatgggctgcggtacgttgctcatcgccctcgtccccggctaccagacgatcggcctggcagcgcctgcgttggtgttgttgggccggttattacaaggattttctgcgggcgttgagttaggcggcgtctcggtctatctgtccgaaatcgcaacgccaggcaataaagggttttataccagctggcaatccgccagtcagcaggttgcgatcgttgtcgccgcgttgattggttatagcctgaatatcacgctgggacacgacgcgatatcggagtggggctggcgaattccgttctttatcggctgtatgatcattccgctgatttttgttttacgtcgttcattacaagaaacagaagcgtttttacaacgcaagcatcgccccgacactagggaaatttttgcaactatcgccaaaaactggcgcattattacggccggaacgctgctggtggcgatgaccaccacaacgttttattttatcaccgtttatacgccgacctatggcagaaccgtgcttaatctcagcgcgcgggacagtttgatcgtcaccatgttagtgggggtgtccaattttatctggttacccattggcggcgcgatttccgaccggattggccgtcgcgccgtgttaatgggcattacgttgctggcgctgatcaccacctggcccgtcatgcagtggctgaccgccgcgcccgactttacccgcatgacgctggtactgctgtggttctctttcttttttggcatgtataacggcgcaatggtcgcggcgttaaccgaagtgatgccagtctatgtgcgtaccgttggtttctcgctggcctttagcctggcgacggcaatttttggcggcctgacgccggccatctctaccgcgctggtaaagttaaccggcgataaaagctcgcccggctggtggctgatgtgcgcagcgttatgtggacttgccgcgacggcgatgctgtttgtacgtctgagtcgcggctatatcgcggcagaaaataaagcctgaaaaaaccacaggcggaaaacattcgcccgtgggtggcaaggcagggttttattgcacgttattatgactgcgaatttcctgccagaccttatcgcagtcagccttgaccgcctgatcgttacccgtgcgcgtcgcctgaatgcactgctgatagtccagtacccgcacgctttcttcgttagcaaattgctgatgtttgcgctcttttttaaggacattcagtacgctttggcaggcctctatcttctcaggcgagccctgtgcggtattgatacaggcgctgtacgcctctttcagccgactatcttcttccggcgcgggtgatgacgcgcaggccgtcaaaccggcggtcatgctggcgatgagtaaaatttttttcataggtcgttcctcaacagcgcggcagaccggcagcctgccgcatctgacatcagaaaatagtgaatggcgcaataacgataaatttcacgtcacgttcatcctggaagatgttgccgtaaccaccgccccagcttggaatattggagtggttgtcatattcggtgaagtgcagtttgaacatggtgcctttggcacgcccctcctgcagggtatagaccgcatccagactgtatgaggactcttcgatagtgcggtttttgtcgtagtaagcatccgggttactttgccaggttgccggtttagcatcccaggcgtaaacgtaagacgcgcccacagcccagcccggcagattccagtttttcaggtcatacatcgcgccgaagaaaaccgccttttcaccgttagcgttaaagtcggagcggttatcccaccagatatccagacgaccgtttgaagaggcgtaggttggcgtcatacgttgcagaaaatagccctgctgaccgtccgctttcacccaggtgccctccagacgcaggtcaaccacttccgcgactttgtagccgaaggtcaacgcctgcagccaggccgtaccgtcgtaaatgtcattcacgctgcgatcgtctactttgtcgcgcgcgccgtagaactggtaactggtggtgaacggattgccgcctaaatcaaatttatagctggcctttgcgaaatattgatcgacatagccttcggactgaccaaacgccgcttccagcaccagatcatttttgaagtcgtacttcgcgccgatggagtggagatagtctacattggtttttttatccgcctgataaaacttatccatttcggtatgccacggcgctttatattcgttagtccacatgtaggaaaaacttaacgcgcccgcatcgccatagtcaaaactggcgccggcttccgcaccctgataggtacccggcataaaactccagtgcggcgctaacagcgtctgaccggtaggctgaatataaccggcgcgcgcccagaccgggccatatttaaatttcgcggcggctttataaagactgataccgctcttatcgccggaatagtcttcgtcgtagcctttattctttttcgagaaggcaatttcgtttggatgaccgctgtcgccgttttctgccatttcaatcgcggtaaacgccgcgatatccagaccgaacatatccgcagcgtaaccagactgaaaatccaggttagcgttccaggtcgcatgagaaaggttagttttatatttgtcgccgtcggtcacatctttgcgatcgcgttcacgctgccaataatagatgccgcccgttaacgtggagtcgtcgaaaaagccggaggcttgcgcctgcggaacaacgatccaccccgacattgctgtgataccggcgatagccagagccagcgtactacgtttgccactaaacgtacgcataagttaatcctctttgacgtataaattgctgccgacaaaagcgaacagcgaaaaaataaaaataaaaagtagcgctgagaaacctcatttactacgttaaatagactatttttcgcgatgcgaattatcaatctctttctgtaaccagtatgtaataatatgagcaaccgcacatatttaattgctttctgttacattcgactgctggtgggggaagcagaccgccagaaagaaaattgacttgttttccataggcatgaaaataattgtctcctgttgacctgacgcttataacatttagattaataatcatttatcagatcaataattttcagagaataattaattcgcctcgcaaaaaagagaatcgacttagaaatgcagagaaaaaacgccgcagaacgcggcgttgacaaggtatttttacagcattcgcctgttggcgcagtgcttattcgcccgctttcgcccaggtatcacgcaggcccacggtgcggttaaagaccagcttatcggccgttgcatagcggctgtcaaggcagaagtaaccttcacgttcaaactggaaagctttccctgctaccgccgctttcagcgacggctcgccatacccctgcttaatcactaatgattcggggttgataacagacaggaagtcctccgcggcgcccgggttcggcacgctgaacagacggtcgtagagacgaatttcaatcggcagcgcatgtgctacgctaacccagtggattacgcctttcactttacgcccgtcagccggatctttactcagcgtatcagcatcataggtacagaagatggtggtgatattcccttcggcatccttctctacgcgctccgctttaatgacgtaggcattacgcagacgcacttctttgcccatcaccagacgtttgtactgtttgttcgcttcttcgcggaaatccgcgcgatcgatccagatctcaccgctaaacggcacttcacggctgcccatctccggtttattcggatggttaggcatggtaaccatttcgctctcgccctgcgggtagttttcgataaccagttttaccggatcgattaccgccatcgcgcgcggcgcgttttcgttcagatcttcgcgaatgcaggattccagcgacgccatctcaatagtgttgtcctgcttggtgacgccgatgcgtttgcagaactcacgaatagaagccgcggtatagccgcgacggcgcagaccggaaatagtcggcatacgcggatcatcccaaccttcgacgtgtttgtcggtcaccagcaggttcagcttacgcttggacatcacggtgtattccagattcaggcgcgagaattcgtactggcgcgggtgaaccggaatggtgatgttgtccagcacccagtcgtacagacgacggttgtcctggaactccagcgtacacagagaatgagtaatgccttccagcgcatcgctgatgcagtgagtaaagtcgtacatcggatagatgcaccacttcgtgccggtctgatgatgctcggcgaatttaatgcgatacagcaccggatcgcgcatcacgataaacggcgacgccatgtcgattttagcgcgcagacaggctttaccctcttcaaaaccgccggtacgcattttttcaaatagcgcgaggttttcttccacgctgcgatcgcggaacgggctgtttttacccggcgcggtcagcgtaccacggtattcgcggatctgctccggcgtcagctcatcaacgtaggccaggcctttattgatgagctcgaccgcataggcgtgcagttggtcaaagtaatcggaggagtagcgaatatcgccagaccagtgaaagcctaaccactcgacgtcgtttttgatcgaatcaacgtactcgatatcttcttttaccgggttggtgtcatcgaaacgcaggttgcactggccctgataatcttgcgcgatgccaaagttcaggcagatagatttcgcgtggccgatgtgcagatagccattcggctccggcggaaaacgggtatggacagtggtatgtttaccactcgccagatcttcatcaataatctgacgaataaagttagtcgggcgggcttcagcctcactcatcgtggattcctcaaagcgtaaacaacgtataacggcatatgatcttataagccggacagactgacaacctttagttacttaaaaagtggctttgcagaaaatattggggctaattgcggtaaaaaaaagcggcgaaggtttccctctgccgcttatgtttcctgtgatatcgccggatggcgtcttacgccttatccggccaggaagcgattatttgctcttgatctcgtacagcggcgtttgacccgctaccacgtgaccatccgctttgatgaccagagcgctgaagtcatcgctgttgctgcaaacaaccgggcttatcttggaacgcgcattggcattcaggaagtccagatccagttccagaaccggctgacccgccgtgacttccgcaccctcttctaccagacgcttgaagccctgaccgttcagcgcgacggtatcgatacccatatggacaacgatctccgcgcctttttcggtttccagacagaacgcgtggttagtgttgaagattttcacgatagtacccgccgccggagaaaccacggttttatcggtgggtttcaccgccacgccgtcgccgaccgctttgctggcgaaagcttcatccggtacctgatccagcgccactacctcaccggtaatcggagagaccagttcagcgatagtcaccgcattcggcaccgcctggggtttggccgccggagcaggtgtcgcaacgtgagccgcatcagcagacgctgccgcgaccggcccccgcgccaccactttcttcatttcatcgccaatcgattccgctttcgcgccgacaataacctgaatggtctgtttgttcagtttcaccacgccggaagcgccgaggcgtttgcaggccgcatcgttgacgcgagcagagtcgttcacggtcaggcgcagacgggtaatgcacgcatcgaccgctttcaggttgtccgtaccgccaaccgcagcaatatagctggtcgccagttgcgttaacccttcttcggtgttgctgttggcttcttccgttaccatctcatcaactttatcttcgcggcccggcgttttcaggttaaacatacgaataaccgcgctgaacagcaggaagtagatgataaagaatacaacgcccatcaccagcaacatccagacgttattgctggccgcaggcaggttatacatcagaacatagtcgatcgcgcctgccgagaaagagaagcccgcatggatacccagcaacgtcgcgacgaacaggctgataccagtcaaaatggcgtgcaggaggtacagcagcggcgccaggaacataaacaggaattccagcggctcggttacgccggtcagaaacgcggtgatcgcgacagacagcagcataccgcccaccatcggacgacgttctttcggcgcggcgaaatacatcgccagagcggcgcccggcagaccaaacatcatgatcgggaagaagccggacataaacatccccgccgtgccgtcgccagcatagaagcggttgatgtcgccgtggaatacagtgcctgcggcattggtgaattcgccaatctggaaccaggcgatggtgttcagtacctgatgcagaccggtggggatcagcagacggttgatgaagccaaagataccggaacccaacgcgcctgcggaaacgatccattcaccgcccgcatggatgccatgctgtaccggcggccagacgtaaccgaaaatagcggccagcaccagacagaaaaagcccgttgcgatcggcacaaaacgttttccaccgaagaaactgagaaaatcaggcagtttgataccagaccagcgattataaaccgcgccgccgaccagaccggtaataatccccgccagcacgcccatgttgatttccgggttaatcgtcaccatcgctttggtcatgacgaagtaacccacggctcccgccagtgctgccgcgcctgcgctatctttagaccaactggaggccacgccgatagcgaaaaccagcgccaggttatcgaaaatagacccgcccgcttgcgcgataaacggcatattcagcaaatctggttggccgaatcgcagcaacaacgctgccaccggcaacacgacgatagggagctgcaacgccctacccagccgctggaaaaaacctaaaatattcatcttattccccctacgagacgccgatatggcttctttgaagccgttttttattgtgctgcaaacgttaaaaacgtgatgttctgtaatcgaacggtgagatcatcttctgcagagtgtgtggaaaattaattcgcctcgcaaattaaacgggtgttttttgtgattataatcactaaatatcgtaatcacccccaccatccactggctaacacggaaaacttattttatgattcaaaaaatcaggacggattgaacacgaaccctggatatccaggttacgcttaatacgatccgccaaattttgacattgattattgaggtgaagaatgagactgatccccctgagtaccgcagaacaggttggcaaatgggccgctcgccatatcgttaaccgtattaatgcgttcaaaccgaccaccgatcgtccgtttgttcttggactgcctaccggcggcacgccgctaacggcgtacaaagcgctggttgagatgcacaaagcgggcgaggtcagctttaagcatgtggtcacctttaatatggacgaatatgttggcctgccgaaagagcacccggaaagctaccacagctttatgcatcgtaactttttcgatcacgttgatattccagcagaaaacatcaatcttctcaacggtaacgcaccggatatcgatgcagaatgccgtcaatatgaagaaaaaattcgttcttacggtaaaatccatctgtttatgggcggcgtcggcaacgacggtcacatcgcctttaacgaaccggcgtcttccctggcttcccgtacccgtatcaaaacgttaacccatgatactcgcgtagcgaactcccgcttctttgacggcgacgtaaaccaggtgccgaaatacgcgctgacggtaggcgtgggtacgctgctggatgcggaagaagtgatgattctggtgctgggccatcagaaagcccaggcgctgcaggcggcggttgaaggcaacgtcaaccacatgtggaccattagctgcctgcaactccatccgaaagcggttgtggtatgcgatgagccgtccacaatggaacttaaagttaaaacattgaaatatttcaatgaattagaagcagaaaatattaaaggtctgtaatgttgtctccgccccgccagtcaatgcggggcggtaaatttttgatatcgggggtcagaatgtatgctttaacccagggccggatctttaccggtcacgaaattcttgatgaccatgcgcttgttgtcgctaatggcctgattgaccgcgtttgtccgatggccgagctgccgccgggaatagaacaacgctcattgaatggggccattctctcccccggttttattgatgtgcagctaaacggctgcggcggagtgcagtttaacgataccgcagaagccgtcagcgttgaaacgctggaaattatgcagaaagccaatgaaaaatcgggctgtactaactttctgccaacgcttatcactaccagcgacgaattgatgaaacagggtattcgcgtcatgcgcgagtatctggaaaaacatccgcaccaggcgctgggtctccacctggaaggcccctggcttaatctggtaaaaaaaggcacccataatcctgatttcgtgcgtaaaccagacgctgcgctggtcgatttcttatgcgataatgccgacgtcatcaccaaagtcactctcgcgccggaaatggtgcctgctgacgtaatcgctaaactggcgaatgcgggcattgtggtttccgcaggtcactccaacgcgacgttaaaagaggcaaaagcgggcttccgcgccgggattacctttgcgactcacctgtttaacgcgatgccgtacattacagggcgtgagccgggccttgctggcgctgttctggacgaagcggatatttattgcggcgttatcgccgatggtctgcatgtcgactacgccaacattcgcaatgccaaacgcctgaaaggcgacaaactttgtctggtgacagacgccaccgcaccggcgggggccaatattgagcagttcattttcgcaggtaaaacaatatactaccgcaatggactgtgtgtggatgaaaacggtacgttgagcggttcgtccttaaccatgattgaaggcgtacgcaacctggtcgcgcattgcggcatcgcgctggatgaagtgctgcgcatggcaacgctctatccggcacgcgctatcggcgttgataagcatctcggtagcattgcgccgagtaaagtcgccaacctgaccgcgttcacccacgattttaaaattatcaagaccatcgttaatggtgacgaggtcgttgacttgagtaagtgagaatatgacaccaggcggacaagctcagataggtaacgttgatctcgtaaaacagcttaacagcgcggccgtttaccgcctgattgaccagcatggtcctatctcgcgcatacaaattgccgagcaaagccagcttgctcccgccagcgtaacgaaaattacgcgtcaactcattgaacgcgggctgatcaaagaagtcgatcagcaggcctctaccggaggccgccgcgctatctctatcgtcacggaaacccgtaacttccacgccattggcgttcgcctggggcgtcatgacaccactttaacgctctacgatctgagcagtaaagtggtcgctgaggagcattatccgctgccggagcgcacccaggagacgctggaacatgcgctgctcaacactatcgccgtctttattgatagttgtcagcgtaaaattcgtgaattgatcgctatctcggtgatcctgccagggcttgtcgatccggaaagcggcgtgattcgttacatgccgcacattcaggttgaaaactggggactggtcgaagcgctggaaaaacggtttcacgttacctgtttcgtgggtcacgatattcgtagcctggcactggcggaacactacttcggcgccagtcaggattgcgaggactcgattctggtgcgcgtccatcgtggtacaggtgccgggattatctccaacggacgcatcttcattggccgtaacggcaacgtcggcgaaattgggcatattcaggtggagccgttgggcgagcgctgccactgcggtaatttcggctgtctggaaaccattgccgccaatgcggcgattgaacaacgggtgctgaatttgcttaaacaagggtatcaaagccgtgttccgcttgacgactgcacgattaaaaccatctgtaaggcggcaaaccggggcgacagcctggcctcggaagtcattgagcatgttggccgccatttgggcaaaacgatcgccattgctatcaacctgtttaatccgcaaaaaatcgtcattgccggcgagatcattgaagccgataaagtcctgttgcccgctatcgaaagctgtatcaatacgcaggcgttaaaggcctttcgcaaaaatttgccggtggtacgctccacgctggatcaccgttctgctatcggcgcatttgccttagttaaacgcgccatgctcaacggaacattgctgcaacgtttgctggaaagctgatgcgctcttatagtatcggattattcacaaattccctgggtagttcatgaccatcaagaatgtaatctgcgatatcgacggcgtgctgatgcacgacaacgtagccgtacccggtgcggcggaatttctgacggggattctggaaaaaggtctgccgctggtgctgctgaccaattacccgtcgcaaaccggccaggatctggcgaaccgttttgctaccgctggcgttaacgtgccggacagcgtgttttatacgtcagcaatggcgacagccgattttctgcgccgtcaggaaggtaaaaaagcgtatgtcgtgggcgaaggcgcgcttattcacgagctctataaagcgggttttaccattaccgatgtaaaccctgattttgtcatcgttggagagacccgctcctacaactgggacatgatgcataaagcagcatttttcgtcgctaatggcgcgcgctttatcgccaccaacccggatacccacggtcgcggcttttatccggcctgcggcgcgctgtgcgcaggcattgaaaaaatttccggccggaagccgttttatgtcggcaaacccagcccgtggatcatccgcgcggcgttaaacaaaatgcaggcgcactcggaagagaccgttatcgtcggcgacaacctgcgcaccgacattctggcggggttccaggccggtctggagaccattctggtgctttcaggcgtatcaacaatcaatgatattgacagtatgccgttccgcccaagctggatttacccttccgtcgccgagatagacgttatctaaacctgtcccctgcctgatgacgcgccgctttcaggcctacggttcgaacaacattgtaggcctgataagcgaaacgtcatcaggaaaaacataattcaattaaaccactataaaactgaagattcatcaataaattcgcgcaatacgtaatcatttttcactaatcaacaatgacgattgcgtttttcatttttcagaccgtaatccccttgcgccttccacgcctttgcggcattttttagtcaagcaaacacaaaaagtacgacgcaacagattaacggagaaggctatgtgttctattttcggcgtattcgatatcaaaacagatgcagcggaactgcgtaaaaaagcccttgaattgtcacgcctgatgcgccatcgcggcccggactggtccggcatctacgcttgcgataacgcgattctcgcacatgaacgcttgtcgattgttgatgttaacgccggcgcccagcccctgtataacgctaagaaaactcacgtgctggcggtgaacggtgaaatttataaccatcagacgttacgcgcggagtatggcgatcgttacgcgttccagactggctccgactgcgaagttattctcgcgctatatcaggaaaaagggccggatttccttgacgatttacaggggatgttcgccttcgccctgtatgacagcgaaaaagacgcttatctgattggtcgtgaccatatcggtattattccgctctacatgggctatgacgaattcggcaacttctacgtagcgtcagaaatgaaagcgctgactccggtctgccgcaccattaaagagttcccggcgggcagctacctgtggagcaaagacggcgaaattcgtcagtactatcagcgcgactggttcgattacgatgcggtaaaagataacgtcaccgacaaaaacgcgctgcgtcaggcgctggaagaatccgtgaaaagccacctgatgtccgacgtgccctacggcgtactgctctccggcggcctggactcgtcggttatctcggcaatcaccaaaaaattcgccgcccgtcgcgtcgaagatcaggagcgctccgaagcctggtggccacagttgcactcttttgcggtaggtctggaaggttcgcctgacctgaaggcggcccaggaagtggctaaccacctcggcaccgtgcatcatgaaattcacttcaccgtccaggagggtctggatgcgattcgcgacgtgatttaccacattgaaacctatgacgtaaccactatccgcgcctcaacgccaatgtatctgatgtcgcgtaagatcaaagcgatgggcatcaaaatggtgctctccggcgaaggttctgatgaggtgtttggcggctacctgtacttccataaagcgccgaacgccaaagagttacatgaagagacggtccgtaagctacaggcgctgcatatgtatgactgcacccgcgccaacaaagcgatgtccgcctggggcgtggaagcgcgcgtaccgttcctggataaaaaattcctcgacgtggcgatgcgtatcaacccacaggataaaatgtgcggcaacggcaagatggaaaaacacgtgctgcgcgagtgcttcgagtcttatctgccagcaagcgtggcgtggcgtcagaaagagcagttctctgacggcgtaggctacagctggattgatacgctgaaagaggtggcggcgaaacagatttccgatcaacaactggaaacagcccgcttccgctttccatacaacacgccgtcgtctaaagaggcgtacttgtaccgggaaatttttgaagaattgttcccggtgccgagcgccgcggaatgcgtacccggcggcccgtccgtggcctgttcttccgccaaagccattgagtgggatgaagcattcaaaacgatggatgacccgtcaggccgcgcggtcggcgtgcatcagtcggcgtaccagtaaattaacgatgacgaaagagcccctaggggctctttttttatagcaacccactttcggaaaaacgattaataaccaataattgccgaatattgcgccacgctgttcgcaacctaaccaaacagacactttccgacgtttttcgatgaaaaagaggttgacgcttcaaggctcaatacgcataatgcgccccgcaacgccgataaggtaacgcgaaaaaagatggctacgtagctcagttggttagagcacatcactcataatgatggggtcacaggttcgaatcccgtcgtagccaccatcttttttgcgggagtggcgaaattggtagacgcaccagatttaggttctggcgccgcaaggtgtgcgagttcaagtctcgcctcccgcaccattcaccgataagcgttgtacggatggggtatcgccaagcggtaaggcaccggtttttgataccggcattccctggttcgaatccaggtaccccagccatatttcttcgagtttgcggttcaccgcgacggtattggggtatcgccaagcggtaaggcaccggtttttgataccggcattccctggttcgaatccaggtaccccagccatcgaagaaatcatctggctacgtagctcagttggttagagcacatcactcataatgatggggtcacaggttcgaatcccgtcgtagccaccatattcagaacgcgtcgaggtattcgaccggttcgaaaataatttgttggggtatcgccaagcggtaaggcaccggattctgattccggcattccgaggttcgaatcctcgtaccccagccacttttaaaaagctcgcttcggcgagctttttgcttttctggcaattcggacagcctgatggcgctacgcttatcaggcctacgggcgaatacaggccgggtaaggtatagccgccacccggcataacacaaactacaaccccaacgcatacttcagcgcctgacgttttagcacgcctgcgcgctgcgccgccattagccccatattgcgtaaaatacgcagtggcggcagttcattgctgaacccggcataaaacagatccattccactttgcatcataaaattatctgccatgcgccgcgtctgatagcgtttcaacaccgaatggctggcccaggactcgccatagctacgggcactcgccagcacatcaatcaacgcatcaacatcccgataccccaggttgacgccctgcccggccagcggatgaatggtatgcgccgcgtcgcctaccagcgccagccccggttgcgcatactgcaacgcgtgacgacgggttagcggaaacgcgcccgccgcgacaggcatcaccgcccccagacgcgccggaaagtgctggttaatttccacctgcaattgcgtcatcgataaactctgtagctggcgaatacgtgccggagcgtcataccacaccagcgacgcccaatcgtcgaacagcggcaaaaaggcgcgcggccccgttggcgtaaactgctgccaggtgctgtcgcctggcgcattttcacacttgacggtgataagcatacacgactgcgcatattgccaggcatgaatgccaattcccgccatttgccgaacctgcgaattcgcgccgtcggcgccaatcactaacttcggcgttacccattcgccgtcggccagttccagcgcataaccatcgtggcggcggtgcaatgccgccagtgaagccggaacgcgcagcgtcacgccggggtgcgcttccagcgcctgccacagcgcctgttgcaggacgttgttctctaccatatagcctaacagcggcagcttgagttcagcggcgtcgaacaccacatgggcgttttcccactcccaggtctccagtcgccgataaggatggctacgcatcccctgcaccgcctcccaaacgcccagccccttgagcagcgccacggatgccgcgctaatggccgaaatccgcacgtcaggctggctgtcagccacaaacggcgcaggcgcggcatgttctattaccatcaccgtaaacccttgctgcgccagacccagcgccagcgcgccgccgaccattcccccgccgacaatggcaatttccgttggttgatttgtcatggtcattcatcctgttacgttttagacaagtttacaggattttttacccattagggctgacgtcagtcatactggtcacaaccgcgccaaagcattacactatgcgccctgcttttcagccactatttcgcaagagcaagtcgatgactaaaaaactccatattaaaacctggggctgtcagatgaacgagtacgattcatcgaagatggccgatctgctggacgccacccacggctatcaactgaccgacgtggcggaagaggcggatgtgctgctgttgaatacctgctcaatccgcgagaaggctcaggaaaaagtcttccatcaattaggtcgctggagactgttaaaagagaaaaatcccgatctgattatcggcgtcggcggctgtgtggcttcccaggaaggcgagcacattcgtcaacgcgcccattacgtcgacattatttttggcccgcaaaccttacaccgcctgccggagatgattaactccgtgcgtggcgaccgcagcccggtggtcgatatcagcttcccggaaatcgagaagttcgatcgtttgccggagccgcgcgccgaaggcccgaccgctttcgtttctatcatggaaggctgcaataaatattgtacttactgcgtggtaccgtatacccgcggtgaagaagtcagccgtccctcagacgatatcctgttcgaaatcgcccagttagcggcgcagggcgtgcgtgaggtcaacctgctgggccagaacgttaacgcctggcgcggagaaaactacgacggcaccaccggcacctttgccgatctgctgcgtctggttgccgccatcgacggcattgaccgtattcgctttaccaccagccatccgattgagttcaccgacgatattatcgaggtgtaccgcgatacgccggagctggtcagtttcctgcatctgccggtacagagcggttccgatcgcgtgttgaatctgatggggcgcacccacactgcgctggaatataaagcaatcatccgtaaactgcgcgcggcgcggccggacattcagataagctctgactttatcgtcggtttcccaggcgaaactaccgatgatttcgaaaaaaccatgaagcttatcgccgacgtcaactttgatatgagctacagctttatcttctctgcgcgtccgggaacgccggctgccgatatggttgatgacgtaccggaagaagagaaaaagcagcgtctgtatattctgcaagagcgtatcaatcagcaggcgatggcatggagccgccgtatgctcggcacgacacagcgcattctggtggaaggcacgtcgcgtaaaaacattatggaactgtctggccgtaccgaaaacaatcgggtggtgaactttgaaggcacgccggagatgattggtaagtttgtcgatgtggaaattactgacgtctatccgaactccctgcgcggaaaagtggtgcgtaccgaagatgaaatgggtctgcgcgtcgccgaaacgccggagtccgtcattgcccgtacccgtaaagaaaatgagctgggcgtaggattctaccagccttaatcctgcaggaaaggcaataatgcccgatggcgctacgcctgtcgggcttcctggtcatggcctgtcgcccgacgggccttgcaattttctctcttcatccccatcttcattgcaatgcttgcgccttttccctatggcgtgaataatttccttagatgccggtaaatgttcagcgtccggcgatacagacacaagaggaacagtttgaatatagacactcgcgaaattacccttgagcccgcagacaacgcccgtctgttgagcctttgcgggccgtttgatgacaatattaaacagctcgaacgtcgtctcggtattgaaatcaaccgccgtgacaatcactttaaactgaccggtcgtccgatttgcgtgaccgcggcgacagatattttgcgaagtctgtatgtcgataccgcaccgatgcgcggccagactcaggatatcgaaccggaacaaattcatctggcgatcaaagaagcgcgggtgctggaacagagcgcggaaagcgtgcctgactatggcaaagctattaatatcaaaaccaagcgcggcgtgattaaaccgcgtaccccgaaccaggcgcagtacatcgccaatattctcgatcatgatattacctttggcgtcggcccggcgggtaccggtaaaacttatcttgcggtcgccgctgcggtagacgccctggagcgccaggagattcgccgtattctactgacccgtccggcggtggaagcgggcgaaaaactcggctttctgccaggcgatttaagtcagaaggtggacccgtacctgcgtccgctgtatgacgcgctgttcgaaatgctcggctttgaaaaagtcgagaagctgattgagcgcaatgtgattgaagtcgcgccgctggcctatatgcgcggacgcacattaaacgacgcctttatcattctggatgaaagccagaacaccactatcgaacagatgaagatgttcctgacgcgtatcggctttaactcgaaagcggtgatcaccggcgacgtgacgcagattgacctgccacgcaacaccaaatccggcttgcgtcatgccattgaagtgctggcggaagtcgatgaaatcagctttaacttcttccacagcgaagacgtggtgcgccatccggtcgttgcccgcattgtgaacgcctatgaagcctgggaagaggccgaacaaaaacgcaaagcggcgttggcggcggagcgtaagcgtgaagcccaggagcaggaacagaaatgagccaggtgatcctcgatttacagttggcctgtgaaaaccacgcgggcctgccggatgaagctcagtttcaacgctggctggacggcgttattccgcagtttcaggaagaggcggaagtcacaatccgtctggtggatgaggccgaaagccatgaccttaatttgacgtaccgcgggaaagataaacccactaatgttctctccttcccgtttgaagcgccccccggcattgaaatgccgctactgggcgatctgattatttgccgtcaggtcgtggagcaggaagcgcaggaacagagcaagccactggaggcgcactgggcgcacatggtcgtacacggtagcctgcatttgctgggttacgatcatatcgacgatgacgaagcggaagagatggagtctctcgaaacggagattatgcttgctatgggctatgaggatccgtacattgccgagaagattgcagaatagtagcttgccggatggcggcgcttgcgccttatccggcctacattcatgccttttgtaggcctgataagcgtagcgtcatcaggcaaaacatgccgtcacagctgagtatacgcatgacgagctttgtattaactaacatgagaacccatacgacgccatgagcgacgacaattcacacagtagtgacacagtaaacagtaaaaagggatttttttccctgctactcagccagcttttccacggtgaacctaaaaaccgtgatgagttgctggcgctgatccgtgattccgggcagaacgagcttatcgatgaagatacgcgcgatatgctcgaaggcgtaatggacatcgccgaccagcgcgttcgcgatattatgatcccgcgctcccagatgattaccctgaaacgcaaccagacgctggacgaatgtctcgatgttatcatcgagtccgcccactcgcgttttccggtgatcagcgaagataaagatcacattgaagggattctgatggccaaagatttgctgccgtttatgcgcagcgatgccgaagccttcagcatggacaaagtgttacgtaccgcggttgtcgtaccggaaagcaaacgggttgaccgtatgctcaaggaattccgctcccagcgctaccatatggccatcgttatcgatgagtttggcggcgtttccggccttgtgactatcgaagacatcctcgaactgattgtcggtgaaattgaagatgagtatgacgaagaagacgatatcgacttccgtcagcttagccgccatacctggacgattcgcgcgctggcgtcgattgaagacttcaatgacgctttcggcacccacttcagcgatgaagaagtcgataccatcggcgggctggtgatgcaggcgttcggccatttaccggcccgcggcgaaaccattgacattgatggttaccagttcaaagtggcaatggccgatagtcgtcgtattattcaggtgcatgtcaggatcccggatgactcgccccagccaaaactggacgaataacagcaatagtggactaaaaatggcatttgcctcgttaattgaacgccagcgtattcgcctgctgctggcgttattattcggcgcctgcggaacactggctttctctccgtatgacgtctggcccgcagcgatagtgtcgcttatcgggctgcaggccttaacgtttaatcgccgcccgctccagtctgccgccatcggctattgctggggactcggacttttcggcagcgggattaactgggtttatgtcagtatcgcgcagtttggcggcatgccgggcccggttaacgtttttctggtggtgctgcttgcagcttatctctcgctgtataccggactgtttgccgggattttgtcgcgcctgtggccaaaaaccaactggctgcgcgtcgctatcgccgcgcctgcaatatggcaaatcaccgaatttttacgcggctgggtgctgaccggcttcccctggctgcaatttggctatagtcaggtcgacggcccgctaaaaggcctggcgccggtaatgggcgtcgaagcgatcaacttcctgctgatgatggtcagcggcctgttagcgctggcactggcgacgcggaactggcgtccgctggctgtcgccgtgattctgtttgctttgccctttccgctacgttatatccagtggtttacgctggaacctaccaaagcgacccaggtatcgctggtgcagggcgatattccgcagtcgctgaagtgggacgaaaaccagctactgaatacgctaaacatttatctcaacgaaactcgcccagagttaggcaaatcacagattattatctggcctgagtcggcgattccggatctcgaaatcaatcagcagcctttccttcgttcgctggacgagatgttacgcgaaaaaaatagcacgctgatcaccggtattgtcgatgcgcgtctcaataaacagaatcgatacgacacctacaatacgattattacgttgggcaaggataatccatacagttatgactcgcccaatcgctacaataaaaatcaccttgtaccctttggcgagttcgttccgctggagtctatcctgcgtccgctggcgccgttcttcgatctgcccatgtcctcctttagccgcggcccttatatccagccgcagttacatgcgcacgactataagctgacggcggcaatctgttatgaaattattcttggcgaacaggtgcgggataacttccgcccggacaccgactatctgctgacgatttctaacgacgcctggtttggtaagtccattggcccgtggcaacatttccagatggcgcggatgcgttcgctggagctggcgcgtccgttgctgcgcagtactaataacggtattacggcggtgattggcccgcagggcgaaattcaggcgatgatcccgcagttcacacgccaggtgctaactaccaaagtcacgccgaccaccggcctgacgccgtacgcacgaaccggcgactggacggtgtggttgattaccgtactgttcggctttggcgcgctggtgatgagcctgcgtcaacgccgcaaataaaacattgcactatccaatgtaggccggataaggcgttacgccgccatccggcagttgtatcgcaccgtgcctgatggcgctacgcttatcaggcctacaacctctcaccgccaccaaaatctcattctggcacgccaattgcttaatataatcaagaggctgcacactccctaccggcgcaaccaggttgcaccacaacacagcatcggtagcaccattattgtgcaaactgcgatttttgcctctgaacggtgcggcgcacttcgcaaaaataaacaatatcgcagcaaaatatttacaacaagccacactaaatgttaacaaacacacataacactgcacgcgcaagttgcaggcaataacaacatcacaatagctatcaatgcgtcgacggcgcagatgataaaggagttggatatgcaattacgtaagctaaccacagcaatgctggtcatgggactgtctgcgggccttgcgcacgcagaagatggcgcgcctgccgctggtagcaccctggacaagatcgctaaaaatggcgtgatcgtcgtcgggcatcgcgaatcttctgtgcccttttcttattacgacaaccagcagaaagtggtcggctattcccaggactactccaacgccattgtggaagtggtaaaaaagaaacttaacaagcccgatctgcaggtgaagctgatcccgatcacctcgcaaaaccgtattccgctgttgcaaaacggaaccttcgattttgaatgtggttcaacgactaacaaccttgagcgccagaaacaggccgccttctccgatacgattttcgtcgtcgggacgcgactgctgactaaaaaaggcggcgatattaaagatttcccggatctgaaaggcaaagcggtcgtcgtcacctccgggacgacctctgaaattctgctgcataagcttaacgaagagcaaaagatggggatgcgtattattagcgcgaaagaccacggtgactcgttccgcaccctggaaagcggtcgcgccgtcgcctttatgatggatgacgcgctgctggccggcgagcgcgccaaagccaagaaaccggataactgggagattgtcggtaaaccgcagtcccaggaagcctacggctgtatgctgcgtaaaaacgaccctgagtttaaaaagctgatggacgataccatcgctcaggcgcaaacctccggcgaagcggaaaagtggtttgataagtggtttaaaaatccgatcccaccgaaaaacctgaacatgaatttcgagttgtctgacgagatgaaagccctgttcaaagcaccgaatgataaagcgcttaactaactaaaactaaatgggacgggactcctgtcctctcgattgtcgctcagcacggacagactataagcctgatggtcgttccccatcgggcctgaaaccgcagatcgccgggcaacaatcttcgagggtagcgctgctacccttttttttcggagtagatgtatgtcaatagactggaactggggtatttttttacaggaagcccccttcggcaataccacctatctcggctggctatggagtggttttcaggtcaccgtagccctttcgattaccgcctggattatcgctttcctggtaggatctattttcggcattttacgtaccgttcccaaccgtttcctctccggactgggcacattgtacgtagaactgttccgcaacgtgccgctgatcgtgcaattcttcacctggtacctggtggtgcctgaactgttgccggaagatcttggcatgtggtttaaggcggaactcgatcccaatattcagtttttcctctcctcaatgatctgtctgggactgtttaccgccgcccgtgtttgcgaacaggtgcgcgccgcgattcagtctctgcctcgcggacagaagaacgcggcgctggcgatggggctaacgctgccgcaggcttatcgctatgtcctgctgccgaatgcctatcgcgttatcgtgccgccaatgacgtcagagatgatgaacctggtgaaaaactcggctattgcatcaaccatcggcctggtggatatggcggcgcaggcaggcaaactgttggattactcggcgcacgcctgggaatccttcaccgccattacgctggcctatgtgctgattaacgccgttatcatgctggtcatgagcctggttgaacgcaaagtccgcctgccgggcaacgtggggagcaaataatgtacgaatttgactggagttcgattatcccctcactgccttacctgctggccgggttggtcatcacgctgaagatcaccgtcaccgccgttgtcgtggggatagtctggggaaccattctggccgtcatgcgcctctcaagctttgctcctatcgcctggtttgctaaagcgtatgttaacgttttccgttccatcccgttggtcatggtcttgctgtggttctatctgattgtacccggctttctgcaaaacgtgctgggactatcgccgaaaaccgatatccgcctgatctccgcgatggtggcattctccatgtttgaagcggcctactattccgagattattcgcgccggtattcaaagcatttcccgcgggcagtccagcgccgcgctggcgctggggatgacccactggcagtcgatgaagctcattattctgccgcaggcgtttcgggcaatggtgccgctgttgcttacgcagggcatcgtgctatttcaggacacctctttagtttatgtactcagcctggcggacttcttccgcaccgcgtcgactatcggcgagcgtgacggtactcaggtcgaaatgattctgttcgccggcgccgtttattttgttatcagcctgagcgcgtcgttgctggtcagctatttgaagaaaaggacagtttaatgattaccctgaaaaatgtttcaaaatggtatggtcactttcaggtgctgaccgattgttcgacagaagtgaaaaaaggtgaggtggtggtagtctgcgggccatcgggttccggtaaatccacgctaattaagaccgtcaacggtctggaaccggtgcaaaaaggcgaaattaccgttaacggcattattgtgaacgacaaaaaaaccgatctggcgaaactgcgttcccgcgtgggcatggtattccagcacttcgagctgtttccccacctgtcgatcatcgaaaacctgacgctggcgcaggtgaaagtgctgaaacgcgataaggccgccgcccgcgataaaggcctgaagctgctggagcgcgttggcctgtctgcgcatgccaacaagttcccggcgcagctttccggcggtcagcagcagcgcgtggcgatcgcccgcgcgctatgtatggaccccattgccatgttattcgatgaaccgacttccgcgctcgatccggaaatgatcaacgaggtactggacgtgatggtcgagctggcgaacgaagggatgaccatgatggtggtgacgcacgaaatgggctttgcccgtaaagtggctaaccgggtgatctttatggatgaaggtaaaatcgtcgaagattcgccaaaagaggagttcttcgctaaccccagttccgatcgcgcaaaggacttccttgcgaaaatcctgcactaatcttcccggcgcgcacgtcagagtgcgcgctacctcacgctttacttcttcgcttctcgaaacgtatccagccgggcgttaaccttgtcacaaagtaccgcttacaaggagccacaatggcactgcccattattattgattgcgatccgggtcatgatgacgcgatcgccctcgttctcgccctcgcctcccctgaactggaagtgaaagcgatcacctcttccgccggcaaccagacgccggagaagacgctgcgcaacgtgctgcggatgctgacactgctcaaacgcccggatattcctgtggcgggcggcgcggtgaaaccgctcatgcgcgaactgattatcgctgataacgttcacggcgaaagcggtcttgacggcccggcgctgcccgagccgtcattcgccccgcaaagcggcactgccgttgagctgatggcaaaaacactgcgcgagagcgcacagccggtcaccatcgtctccactggcccacagaccaacgtggcgctgctgctgaatagccatccggaactgcatacgaaaatcgcccgcattgtgatcatgggcggcgcgatggcgctgggtaactggacgcccgctgcggaatttaatatttacgtcgatccggaagcggcagaaattgtcttccagtcaggcattccggtggtgatggccgggctggacgtcacccataaggcgcagattcacgccgccgatatcgagcgtttccgcgacatcggcaatccaatttcgacgatcgtggctgaactactcgacttcttctttgaataccacaaagacgaaaaatggggatttgtcggcgcgccgctgcacgacccttgcactatcgcctggctgctgaaacctgagattttcaccaccgttgagcgttgggttggcgtggaaactcaggggaaatatacccaggggatgacggtggtggattattatttcctgacggggaataagccgaatgcgacggtgatggtcgatgtagaccgtcagggatttgtcgatttgctggcggaacggctgcaatactacgcataaagcgcaaagaagaatccagggatgaacagcgatgttttggcgtaacaatagacctgaaatcagcctgctacagcacgacgtagcccatataacgttttcagtacgtaacggaaaagcattgcttcgtccctgcattatccacgatcccgactctgacgccggtattcatatgctctcctggcatggctcgccgctgattcgtttttacactgaagcctggtgcccaacctgcgcagaatttgtttatgccggttttagcaatgatgatgaaggcgccgcgcagtttttatcctcacttgccgagtggaatcagccaggagtcgggttgaacgaagcatttaccgccctgacgccgctgttttcactctttgccgatggctattaccggctggaagcccaactacactcttaacatggcggacggcaaccgtccgctcacgataatgaaccttacggctcaaacggcctgcgctggaactgatcgtgcccacacttcgggcagagcggcagcacatccggcgtgtaaaccgccagatgatagtggcatttctcgcacaccagattccccaaccccaccacttcgccactgtgatacacgccgtggtgattcaaatcctggaagacttcacgccattccagctgggttttgtcggtaatatccgccagttcctgccagagactctctttaatcacccgcaagaagacgctatcttcctggctctcttcgtagctcatggcgaactcttccagatcgcgtctgacagcgcgcgtcagttcgtccacctcggttcgcgttaactcccctgtttgcatcacgcgctggcgcgcctgctccaccagcgcatcaatgtcgcgctcgccattgcgtaaacgctcgcttaatgaggccaccagttcacgataatattgagcaaccttgttcatcacttcacctcttggatcgttaactgcctataataatagacgttatttgcgttacgctttgcaaggctgcccacagagtctgtaaattcttgtcaggccgactcgcgtatccagcgcgtcagcgaggtacgatcgacatttaaccgtttcgccactaacgatttattatccctttccgcctctaataattttctcaaaatacgcaggcgaatcgttttataatcgccagccagcatctggcagtcgtggcaggtacttggctcgcgtcggctcccctcttccaaatcgtccagcaagaggcggccctcatccagagttgccggggagtgatcaatagagagcaccagccgttcgataatattgcttaactgcctgacgtttccgggccaggcgaagcgctgaagctcctgccacagcgccggggttaacgttagtgccgggcgtttataatgctggctgaaactagtaagcagcgacaggccgatggctttgatatcctccggacgtttgcgtagcgggatagtggttacttttaatacgttaagccgataataaagatcttcgcgaaatgtcccatccgcaatgagcttcgttaacgtctgattggtcgccgcaatcacgcgaatatcaacaggtatcatctggtctgagcccagccgcataatctgccgctcctgcaatacccgtaataagcgcgtctgtagcggtttatccagttcgctaatctcatccagaaaaatggtaccgtggtgcgctaattcaaacaggcctattttgcctttcggcgacgcgccggtaaatgcgccggcgacatagccaaagagttcgctctccagaatctgagtggccatcgcgccgcagttaatggcgacaaacaggccgttgacgcgttggctggcattatgaatactttgcgccagcacctcttttcccgtcccgctttcgccattaattaagatagtcgcgtccgtaccggcataatttttaatgatcgccagacgacgcagcatttccgggttttcggtaagcagatcgtcgaaatgatagcgggcgctcaagccgcggcgagacagttcctggcggcgaacatgatgttccgccccctgtaaactggagacggtttgcatcgtcaacaccacccggcttaactgtctggccgcaaataccggatacagattaactaccatcgcgccttgcggtgtatcgacgactttcgcgctgacggtttttccctcacgtaatgtatgccgctcctggtgcaatacctgtttcaggaaagatgcgtcataaatttcaccggaggcgttaattttaaaaagttggctcgcatatttattgtaatgcagtaacgcgccggtatcatcaagcgtgataacagctttatcaaactgatcgagaatcagctgcagatgatggcgctccagtaattggctgcgaaaagccagatataatgagcgggcttcttccagagcttcggttattgaggcggggctggaatcaagtaaacggaattgcgagcccagcggtgaaaaataatcctgacaaacggtatcgccaacaatgcaatctaatggcgtggacgctaattgccgcttcaggcaagaaatcgtttctttatcatttccctgtaaggtaaaaattttatagttaatatttaactgttccgctacgcgcgcgcatcctttgatcacactggaaaagccgacaataccgacagtgcctttttgtcctttaaaagggataagcgcatcaagaatgtcgtagccggacattttaatttcgactaccggtaatttactgtgcttttttaatatttccgcacagccgccacgactaatcagtacctggtgcccacgggactctaataaaggtagctcatccaggatacgattaagcgtcgtttgatgaatagtgacggcgtaatccaactgcgcgaccagcgcctcggcagcctttgccagttgcggataaggagagacaaaacagagaggagatgcggctatatctttcgtcttattcatcactcaccatcctgttggtttataaacgggcgagaccgcccgtcgtgatttattttccgccgaaacgctaaccgcctgcggcggctgggttcagtttacgatcgtagcgtttttttatccatacggtcaggaagggggcgcacagagcggtaataatcgtcgaggccgccacctgcgccgccgccgtcgacgccaggtcggtaaaatgcggatcgagcagcgcgattgccgctggcgtcgcgacggcgttgccagaggtggtggataccgccgcgcctgccacgccgctgcctcccgtcacacgatcggcgaaaatattaaaaaatccgccaatcgccaccgtcatgagtcccagtaaaatgcctgaagaacctgccgtgataagtcttgcgaaatcaatactgtatcctaacccaaaggcaaaaaagggaatcgttaccacgctgccctgtttaagaaacttgcgcatgtcctcatccagattgcccaaaatcatgccaatgataatgggaataataaccgccaccagattcataaagggtatcgacaccatgcctgccgatcctaacgccagcatggtgaaaaagggaccatcgttcaacgatattaccgcaatcgcgccgccgtcggtttcatcgccgtactcccccaccaacgcggcatataacccactgttcgagttggtcatcgccgaaataatcgctaaagccgacagacctaataacccatccgggccgcaaaatttcccgaccagaatgccaataatcacgccgctggcaaatttcgcaaaggtgatcgcagcgccttttttcaacgctttcggcgcggctttaaactggatatccgcgcccatacagactaaaaacatgcctaaaatcgccattgcgccatgcgaaatagagatgacaaaaccgcctatttccagcgcctccggcgcaaaagttttaaacaaggcgccgatgatcagcggtacaaccatcataccaccaggaaaacgttccagtgtttttttaattttcatagcttattcccaggagataaccggacagcttgtgctgcccgatttggtatcagaacgtcggcgcgatcttataaatagagaattcgttatgacctaaatcttctgatttagtcgttttcccattcgcgacgcgtaaaatttcctgataaatttcctcgcccatttgcgtaatagaagcctcgccagacataatggcggacacatcaatatcaatattgtcctgcatcatttcccacgttgctttattacccgtaatttttattaccggcgctattgggttaccggcaggcgttccgcgaccggtagtaaaaataacgatctgcgctccacccgccaccatgccggaaatagattcaatatcctgccctggggtatccataatccacaggcccggatgcgttggactatcggcatattccagtacgccctgtagcggcgcatgacccgctttatgcatacaacctaacgatttttcttcaatggtagtcagcccgcctttaatactgcccggcgtcggctgtcccccgcgaatatcctcgcccagcgcttttgctcgcgcctcacagccgaccactaaatcaatgagctgttgaccaacctccggcgtcaccgcgcgtttcgccatcacatgctcggcgccaataaattccgtcgtttcagaaagaattgagcttccgccgcagcgtatcagcttatccgaggcgaccccgcaggaagggttagacgccagccccgatgtcgtatctgacccgccgcactccatcgccagcagcagctcgctaaccggtgcttgctgcggtttttgcatggagagttgttgcgcatagtcgcgggccagcgaaatccccctggcctgacatttaagcgtgccgccctcttcctgaatggtaatgcaggaggtcggtttgccaaatgcggtaatctcttctgcgatgcgcagcggctccgcgccttcacagcctaagcccacaaccacaatagcgccgacgttgggattattcgccacattaatcaatgtcttttccgtcagacgcgcatcgcctgccacctggcagcagccaaaatcgttattcacccatgtcgcaccttttacctgccgggcaatatcctgggcaactttattcgcacaaacgctggtaggtaaaatcagtacataattacggatgccaaaacggccgtcagggcgtcggaaacccaaaaaagtctcattgctcataatcattttcccttgttttatattatttccagtcaccacgtccgcgttcgctttccacattgtggacgtgcacatagtcgccactttttatttcctgagtggcgcggccaatggattcgccatatttataaacttcgccatgaaaaggcacatcgcagatggcgaatttgtggccaaatggcacatcctgatgtaacacaacgcttatctcgcgttcgccaatgaacattgtggcggtttcgccggccttgagcgccgtaatagccgtcgcgacgcaatcctgagggtgaatcaccactgcattttttttcacgattaactcctttgctttagtcctgtcttccctaatcaaaaggcgtgccattttttaactgcatggtttatatgactttatttttacaggccgatctggcggtgacaggaactgcggtaatttgcctcagtcgtgtcgcattttgcgtcacctcctcatgaacgcctagcgcgacaaatgttctaccccctgttttgacgtgcgtgtttgggctatgctatgcggatctaaacaccacctctaaagctacatttgtagctgtatcgaaaacaggactactggctgccatgcaagagcaataccgcccggaagagatagaatccaaagtacagcttcactgggatgagaagcgcacatttgaagtgaccgaagacgagagcaaagagaagtattactgcctgtcgatgcttccctatccttctggccgactacacatgggccacgtacgtaactacaccatcggcgacgtggttgcccgctaccagcatatgctgggcaaaaacgtgctgcagccaatcggctgggacgccttcggcctgccggcggaaggcgcggcggtgaagaacaacaccgcgccggcgccgtggacgtacgacaacatcgcgtacatgaaaaaccagctcaaaacgctgggttttggctatgactggagccgtgaaatcgcgacctgcaccccggaatactaccgttgggaacagaaattcttcaccgagctgtataaaaaaggcctggtgtacaagaagacttctgccgttaactggtgcccgaacgatcagaccgttctcgccaacgaacaggtgatcgacggctgctgctggcgttgcgacaccaaagttgagcgtaaagagatcccacagtggtttatcaaaatcaccgcttacgcagacgagctgttgcgcgatctggataagctggaccactggcctgataccgtaaaaacgatgcagcgcaactggattggccgctctgaaggcgtggaaatcaccttcgatgtgaagggttacgataacacgctgaccgtctataccacccgtccggatacctttatgggcgccacctacctggcagtggccgccggtcatccgctggcgcaaaaagcggcggcgaacaacgccgagctggcggcgttcatcgacgaatgccgtaacaccaaagtggccgaagccgaaatggcgaccatggagaaaaaaggcgtcgacaccggctataaagcgattcatccgttaactggcgaagagatcccggtctgggcggcaaactttgtcctgatggagtacggcactggcgcggtgatggccgttccgggtcacgatcagcgcgactacgaatttgcctccaaatacggtttgaccatcaagccggtgattctggccgctgacggttccgagccggatctttccgaacaggcgctgaccgaaaaaggcgtgctgtttaactccggtgagttcgacggtctggcctttgaagcggcgtttaacgccattgccgataaactggcggaaaaaggcgtcggcgaacgtaaagtgaactaccgtctgcgtgactggggcgtttcccgtcagcgttactggggcgcgccgatcccgatggtcaccctggaagacggcaccgtgctgccgacgccggaagatcaactgccggttattttgccggaagacgtcgtcatggacggcatcaccagcccgatcaaggccgatcctgagtgggcgaaaaccaccgttaacggtatgccggcgctgcgtgaaaccgacaccttcgacacctttatggaatcgtcatggtactacgcgcgttacacctgcccgcagtatcaggaaggaatgctggattcgaaagcggcaaactactggctgccagtcgacatctacatcggcggtattgaacatgccatcatgcacctgctctacttccgcttcttccataagctgatgcgcgatgcgggcatggtcacctctgacgagccggctaaacagttgctgtgccagggcatggtactggcggatgcgttctattatgtcggcgagaacggcgagcgtaactgggtttcgccagttgacgctatcgtcgagcgcgatgaaaaaggccgcatcgtcaaagcaaaagacgcagcgggtcatgagctggtctacactggcatgagtaaaatgtccaagtcgaaaaataacggtatcgacccgcaggtaatggttgaacgttatggcgcggatacggtacgcctgtttatgatgttcgcttctccggcggatatgactctggaatggcaggagtccggcgtagaaggcgcaaaccgctttattaaacgcgtctggaagctggtttacgaacacaccgctaaaggtcctgtcgcggcgctgaacgtcgatgcgctgagcgaagatcaaaaagcgctgcgtcgcgatgtgcataaaaccattgccaaagtgaccgatgatatcggccgccgtcagacgttcaacaccgccattgcggcgatcatggagttgatgaacaaactggcgaaagccccgcaggaaggcgaacaagaccgcgcactgcttcaggaagcgctgcaggccgtcgtgcgtatgcttaacccgttcaccccgcacgtctgctttaccttgtggcaggaactgggtggcgaaggcgatatcgacaacgcgccgtggccggttgccgacgagcaggcaatggtggaaaacaccacgctggttgtcgtgcaggttaacggtaaagttcgcggtaagatcaccgttgcggtggatgccaccgaagaacaggtgcgtgaacgtgcaggccaggaacatctggtggcaaaatatcttgatggcgttaccgtgcgtaaagtgatttacgttccgggtaaactcctcaatctggttgttggctaagcgcgggaggaagcgtgcgatatctggtaacactgttgttatctctggcggtgctggtcaccgccggatgcggctggcatctgcgtagcactacgcaggttccggcttcaatgaaaacgatgatcctcgattccggcgatccgaacggtccgctaagtcgtgcggtacgtaatcagttacggctgaataacgtaaacctgcttgataaagacacaacgcgcaaagacgttccgtctctgcggcttggaacggtgactatttcgcaggatacggcgtcagtgttccaggacggccagacggcggaatatcagatggtgatgaccgtcaatgcctcggtattgattccgggccatgacatctatcctatcagcacgaaagtgtaccgttcgttcttcgataacccgcagatggcgttggcgaaggataacgagcaggccatgatcgttcaggagatgtacgacaaagccgctgaacagctgattcgtaagctggccagcgtccgcgcggcggatattcaggcgacgaaagaggaggctaccgccgacaatgagacggcggcgcccgcctctacgccagcacgcgtctccactacgctgagtaactaatgatcaggttgtatcctgaacaactccgcgcgcagctcaacgaagggctgcgtgcggcatatctattattgggcaacgatccgctgctgctgcaggaaagtcaggacgctattcgtctggcggctgcgtcgcaaggcttcgaagagcaccacgcttttactctcgatcccagtaccgactggggatcgcttttctcactctgccaggcgatgagcctgttcgccagccgccaaacgctggtgctgcaactgccggaaaacgggcctaacgcggcaatgaatgagcaactcgccaccctgagcgagctactgcatgacgacctgttattaatagtacgcggaaacaagctcaccaaagcgcaggaaaacgccgcctggtataccgcgctggcagatcgtagcgttcaggtcagttgtcagacgccggagcaggcgcagcttccccgctgggtggccgccagagcgaaagcacagaatttgcaactggatgacgccgcgaaccaactgctgtgctattgctatgagggcaatctgttggcgctggcgcaggcgctggaacggctgtcgctgctttggcctgacggtaagttaacgcttcctcgcgtggagcaggccgtcaatgacgccgcccactttacccctttccactgggtggatgcgttactgatggggaaaagcaaacgcgcgctgcatatcctgcaacagctacgccttgaaggcagcgaaccggttattctgctgcggaccctccagcgagagctgctgctactggtaaatctcaaacgtcagtccgcgcatacgccgttacgcgcgctgtttgataaacaccgggtctggcaaaaccgtcgccccatgatcggcgacgcgttgcagcgtctccatcctgcacagcttcgccaggccgtgcagttactgacgcgtacagaaattacgctcaaacaggattatggtcagtcggtatgggcagatcttgaagggctgtcgctcctgctctgccataaggcgctggcagacgtatttattgatgggtgatatgaaatcgttacaggctttattcggcggcacctttgatccggtgcattatggacatcttaaacctgttgaaacgttggcgaatctgatcggcttatcgcgggtgattattatgcctaacaatgtgccgccgcatcgcccccagccggaagcctccagcgcgcagcgtaaatatatgctggagctggctatcgccgataagccgctttttacgctgggtgaacgcgagctacagcgaaacgcgccctcttacactgcgcaaacgttgaaagcatggcgcgaagaacagggccccgaagcgccgctggcgtttattatcggccaggactcgctgcttaacttccccacctggcatgattacgacaccatccttgataacactcacctgatcgtttgtcgtcgtcccggctacccccttgaaatgacgcaggcgcaacaccagcagtggctggaacagcatctgacccatacgccagacgatctgcaccagttgccagccggtaaaatttacctggcggaaacgccatggcttaatatctccgcaaccctcatccgcgaacggctggaaaaaggcgaatcctgcgacgatctgttgccggaaaacgtgctgaactacatcaatcagcaggggttataccggtaagcacattgcgtagcgccgccagcagacgctcgttttgcgcagcgctgcgtatcgccacacgataatagcggctgtccagccccgggtagttagcgcagctacggattaaaatccgctgcgtcagcaaccgtcgctgcagatcaatatcctctcgctcacagcgtaacaacagatagtttgcccgcccgggataaaccgtcagcaggggaagctgacaaagcgcctgataaaaccgggcgccctcctcccgtaaccaatgccaggtcgcctgttgccaggcactatcctgtaacgctacctcaccggccagcgccgccagcgcgttaaccgaccacggcatttgttggcgacgcatccgcgccaccgccgcgtcatcgctattgacgagatatcccaaccgcaggccgggaatggcataaaatttggtcagcgaacgcagcacccagatatgcggattatctttaagagcaggaataaagcccgtctcatgcggaataaaatcgataaacgcttcatccaggatcaggttaatgttcagcgatttgcagcgatcggcaatggcctgtaataactgccgctccggcagcaggccggtaggattattgggcgtacacagaaacaggcagtccagatcgggcgtcaacgcctcaagaatggcatcggtaagctgccagccatccgcttcgcgtagagaccagcgacgaatttcacagccaatttgcgccagcgcccggccatactccgcgaaacctggcgtgacaattattgcacgacgcggtttaagaccgctcgccacggtaaagattgactccgtctcgccatttcccgccagtatccacgatgccggcacctggtgatgacgcgccagcgcctggtgcaaatgaaaataatcggcgtccgggtagcgctcaatgcagtccagattgtcgataagcgcgcgtttcacgctgacaggcatacccagcggattaatgtttgcgctaaaatccagtaactggtcaggcgagatgcccaacaccgtcgcggcttcccgaatattaccgccatgcgcgctgttgaataacgccattatgcctccggccaaaaaacgctattttagtgaaaaaaacgttgcgcaatcaggggcattatcatgttttgcgcatttaacctcatgaggaataccatgcgattgtggctggtgcgtcatggcgaaaccgaggccaatgtcgccgggttgtatagcggacatgctcccacgccgttaacggaaaaagggattggccaggcgaaaacgctacatactttattgcgccacgcgccatttgacagggtgttatgcagcgagctggagcgcgcgcgccataccgcccggctcgtactggagggccgggatacgccgcaacacatcttacctgagcttaatgagatgtacttcggcgactgggaaatgcgccatcaccgcgacctcacccatgaagatgccgaaagctatgccgcctggtgtacggactggcagaatgcggttccgaccaatggcgagggttttcaggcttttacccggcgcgtagagcgctttatctcgcgactcggcgcgttcagcgattgccagaacctgctgatcgtcagccatcagggcgtactcagcctgttgattgcccgcctgctcgcaatgcccgccgcctcgctatggcatttccgggtagaacagggatgctggagcacaatcgacatatgcgaagggttcgccaccctgaaagtattaaatagtcgtgccgtctggcggcctgagtgatgaattttccgttttttctcgccgcagcggtttcgcccattgacagcccccgacaggctgttattctccgcagccaggcttttttcaccttgcagagctttgcagaaattgttttacaaaaatggcgatgctttctgtgacgtgggatgggatgataatctggttttaaacgccgatccggcgacataagtcccggtatcgccgctgattcaggtatactacacggcgtcccgccggaaggttagcgttaactcgcaacgccttaccggtccagcctgttggccttttttctatcgttataacgcaattattcacccagggggaaaacttgcagggtaaagcactccaggattttgttatcgataaaattgatgacctgaaaggtcaggacatcatcgccttagatgttcagggtaaatccagtatcaccgactgtatgattatttgtaccggcacctccagccgtcacgttatgtctattgccgaccacgtggtgcagtcgtcgcgcgcggccggtatgctgccgttgggcgtcgaaggcgaaaatgcggctgactggattgtcgtcgatctgggcgatgtgattgtgcatgtcatgcaggaagaaagtcgccgcctgtatgaactggaaaaactctggagttaatgcgtgaagctgcaacttgtcgctgtcggcacgaagatgcccgactgggttcaaacgggatttacggaatatctgcgtcgttttccgaaagatatgccctttgagctgatcgaaatccctgcgggcaaacgcggcaagaacgcggatatcaaacgcattctcgacaaagagggcgagcagatgctggccgccgccggtaagaatcgcattgttaccctggatattccaggcaagccgtgggatacgccgcagttagccaatgagctggagcgctggaaacaggacgggcgcgacgtcagtttgctgattggcggcccggaaggattatctcccgcctgcaaagcggcagcggaacagagctggtcgctctcggcgttaacgctccctcacccgctggttcgggttctggtcgcggagagtttgtaccgggcgtggagcatcacaaccaaccacccttatcaccgtgagtgatcgtgaagtcttgagaagattaagcagcggatgaaacgacaaaattcttttcgtgactatacggctgagtccgcactgtttgtgcgtcgggcgctggtcgcctttttgggtattttgctgctgaccggcgtactgatcgccaatttgtataatctgcaaattctccgttttaccgattaccagacccgctcgaacgaaaaccgtatcaagctggtgccaattgcgccaagccgcgggataatctacgaccgcaacggcattccccttgcgctgaaccgcactatctatcagattgaaatgatgccggaaaaggtggataacgttcagcaaacgctggatgcactacgcagtgtggtcgatttaaacgacgacgatatcgccgcctttaaaaaagagcgcgcccgatcccatcgctttacttctattccggtgaaaacaaacctgacggaagttcaggtcgcgcgctttgctgtcaaccagtaccgttttccgggcgtcgaagtcaaaggctataaacgccgctattatccatacggatcggcgctgacccacgttatcggctacgtatcgaaaatcaatgataaagacgtcgagcgtctcgacagagaaaacaaactggcgaactacgccgccacccatgacatcggcaagctgggcattgagcgctactatgaagatattctgcatgggcaaaccggttatgaagaggttgaagtcaacaaccgcggccgcgttattcgccagcttaaagaggtgccgccgcaggccggacacgatatctacctgacgctggatctcaagctccagcagtatattgaaacgctgctggcaggcagtcgcgcggcggtgattgtcaccgatccgcgtaccggcggcgtgctatcgctggtctccatgccaagttacgaccctaaccttttcgtggacggcatctccagcaaagattactccgggctgcttaacgacccgaacacgccattagtgaaccgcgcgactcagggtgtctacccacccgcttctaccgttaagccttacgtcgccgtatcggcgttaagcgctggcgtcatcacccgtaacaccagtcttttcgaccctggctggtggcagttgccggggtctgagaaacgctaccgcgactggaaaaaatggggccacgggcatctgaatatcaccaaatcccttgaagagtcggcagataccttcttctatcaggtggcctatgacatggggatcgatcgcctgtcagaatggatgggtaagttcagctatggtcactataccggaattgatctcgcagaagagcgctctggtaatatgccgacccgcgagtggaaacagaaacgctttaaaaaaccgtggtatcagggcgatacgattccggtgggcatcggccagggctactggacggcaacgccgattcagatgagtaaggcgctgatgatccttattaacgacggtgtagttaaagtcccgcatctgttaatgagcaccgcggaaaacggtaaacaggtgccgtgggtacagccgcatgagccaccggtgggcgatattcactccggctactgggaaattgcgaaagatggcatgtatggcgtcgccaaccgccctaacggcacggcgcataaatattttgccagcgcgccctataaaatcgcggcgaagtcgggcaccgcgcaggtctttggcctgaaggccaacgaaacgtacaatgcgcataaaatcgccgagcgcctgcgcgaccataaattaatgaccgcctttgcgccgtataacaatccccaggtcgccgtcgcgatcatccttgaaaacggcggcgcaggcccggcagtaggcacgatcatgcgccaaatccttgatcacatcatgctgggcgacaacaacacccatttgcctgcggaaaacccggtggttgcagcggcggaggaccaataatcatgacggataatccgaacaaaaaaaccttctgggataaaattcatatcgatcccacgatgctactcattctgctggcgttactggtttatagcgcgttggtcatctggagcgccagcggccaggacatcggcatgatggagcgtaaaatcggtcagattgcgatggggctggtggttatggtggtgatggcgcagatcccgccgcgcgtgtatgaaggctgggcgccctatctctatatcatttgtatcattctgctggtcgccgttgatgccttcggcgcaatatccaagggcgcgcagcgctggctcgatctgggaatcgttcgctttcagccttcggaaatagccaaaatcgccgtgccgctgatggtcgcccgctttattaaccgcgacgtctgcccgccctcgctgaaaaataccgccatcgccctggtattaatctttatgcctaccctgctggtcgccgcccagccggacctggggacgtctattctggtcgccctttccggtctctttgtcctatttttgtctggcctgagctggcgcttaattggggtcgccattgtattgatcgctgcatttattcctattttgtggtttttcctgatgcacgattaccaacgccagcgcgtcatgatgctccttgatccggagaccgatccgctgggcgcgggctatcatattattcagtctaaaatcgccattggctcaggcggcctgcgcggtaaaggctggctccacggcacccagtcgcagctggagtttttacccgaacgccataccgactttattttcgcggtactggcggaagagctcggtctggtgggcatcctgattctgctcgcgctctatattttgctaataatgcgcggtctgtggattgccgccagagcgcaaactacatttggtcgcgtgatggctggcggattaatgttaatattattcgtttatgtcttcgtaaatattggtatggtgagcggtattctgcctgtggttggagtacctttacccttggtcagctacgggggctccgcactgattgtgctgatggccgggttcgggattgtgatgtcgatccacacccacagaaaaatgttgtcgaaaagcgtataaggggtgcgcaatgcataagcagttgcctgtaatctgcgtcgcggcagggatagtactactcgcggcatgtactaatgacggcggtcagcagcaaaccaccgtcgcgccgcaacctgcggtatgtaatggtccgactgtggaaatcagcggagcggaaccgcgttatgaacctctgaatccgaccgcaaaccaggattatcagcgtgacggtaaaagttataaaatcgttcaggacccgtcccgctttagccaggctggcctggccgctatttatgatgcggaacccggcagtaatttaaccgcctccggggagatgttcgatccgatgcagcttaccgccgcccatccgacactgcctatccccagctatgcgcgaatcaccaacctggccaacggtcgcatgatcgtcgtgcgtattaacgatcgcggcctctatggcaccgatcgggtcatctccctgtcccgcgcagcggcggatcgtctgaatacctcgaataatactaaagtacggattgaccccattatcgtggcgccggatggttcgctctccggcccggggatggcctgtacgacggtggcgaaacagacctacgctctgcccccgcgccctgatttaagcggcggcatgggaagcgcctcttcagcgcctgcgcaaccgcaaggcgacgttcttccggtcagtaattccacgttgaaaagtgacgataccaccggtgcgccggtgagcagcagcggcttcctcggcgcgccgaccacgctggcgcctggcgtgctggagggtaatgaaccgacgccggcgccacagacagcgccggtttccgcgccggtgacggctccagcgactgcgacgccggtgagcgcgcctgccgccgcagccccggtatctgccccggtgagcgcgcctgccgccgcggcgagcggtcgtttcgtcgtccaagtcggcgccgtcagcgatcaaacgcgtgcgcagcagtaccaacagcgtttaagccagcagttcagcgtaccaggacgcgtaatacaaaacggcgcggtctggcgtattcaactggggccttttgccagtaaagccgaagccagcgcgttacagcaacgtttgcaaacagaagcacaattacagtcctttatcgccagcgcgcagtaaccgattgcaggtatctgtactgtcaatttctgtaaatgacattaacaaagtcacgcggaaagtcagatgcctgccagttatgcttttgctatagtagggctcttttttaatttcatcacggacgtcgtagttcagaccatgaagaccactttttccgctcgttttatgcagcgcatggcgctcaccacggcgctttgtgccacgtttatctcaaccgcacatgccgatgacctgaatatcaaaactatgatcccgggtgttccgcagatcgatgcggaatcctacatcctgatcgactacaactccggcaaagttctggcggaacaaaacgccgacgaacgtcgcgacccggctagtctgacgaagatgatgaccagttacgtcatcggacaggcaatgaaagcgggtaaatttaaagaaaccgacctggttaccgtcggtaatgacgcctgggccaccggcaatccggtatttaaaggctcttcgctgatgttcctcaaaccgggaatgcaggtaccggtctctcagttgatacgcggcatcaatctgcaatccggcaatgacgcctgtgtggcgatggctgatttcgccgccggtagccaggatgctttcgtcgggctgatgaacagctatgtgaacgcgttggggctgaaaaatacccacttccagaccgtacacggcctggacgccgacggacaatacagttcagctcgcgatatggcgctgattggccaggcgttaattcgagatgtgccgaacgaatatgccgtttataaagaaaaagagttcacctttaacggcattcgccagttaaaccgtaacggtctgctgtgggataacagcctgaatgtggacggcatcaaaaccggccataccagcaaagcgggctataatctggtcgcttccgcaaccgaaggccagatgcgattgatttccgccgtaatgggcggacggacctataaaggccgtgaaacagaaagcaaaaaactgctgacgtggggcttccgtttctttgaaaccgttaatccgctgaaggctggtaaagagttcgcctctgaacccgcctggtttggtaataccgatcgcgcctcgctgggcgtcgataaagacgtttacctgacgatccctcgcggtcgcatgaaagatttgaaagcgagctatgtactgaataccgcagaactgcacgcgccgctgcagaaaaaccaggtggtcggcaccatcaacttccagctggacggtaaaaccatcgagcagcgtccgctggtcgtactgcaagagatcccggaagggaacttcttcggtaaaatcattgattacattaaattaatgttccatcactggtttggataaaaattgaacgcttgaaagtgtgattttcgtccccatatactatgcatcagtaaaactcccgccctgtggcgggagttgttatttttttacgtaatgccggagctgacatgaaaaccaaacttaacgaactgcttgaattccctacgccatttacttacaaagtaatggggcaggcgttacctgagctggttgatcaggtggttgaagtggtacagcgccatgcgcctggtgattactctccgacggtaaaaccgagcagcaaaggcaactaccactcggtctctatcaccattaatgccacccatattgaacaggttgaaacgttgtacgaagaactgggtaatattgatatcgtgcgaatggtattgtaatacatccagacggttacccggtcttatccgggtaactccccgcctcccccgctgtgatatactttcctctcttttttcattctctacggagatgccgttttgtatcaggataaaatccttgtccgccagctcggccttcagccctatgaagctatctctcaggccatgcataactttaccgatatgcgcgatgaaaacagccatgatgaaatctggttggttgagcattacccggtgtttacccagggccaggccggtaaagcggaacatatattgatgcctggcgatattcccgttgtgcagagcgatcgtggaggacaggtgacctatcatggtccgggccaacaggtaatgtacgttttacttaacctgaaacgacgtaaactgggcgtgcgtgatttagtcaccctacttgaacagaccgtggtgaatacgctggctgaaatgggtattgaggcgcatccgcgcgccgatgcgccgggcgtctacgtgggtgaaaagaaaatctgctcgctgggtttacgtatccgtcgcggctgctcattccacggtttagcgctaaacgttaacatggatctttctcctttcctacgcatcaacccgtgtggttatgccggcatggaaatggctaaaataacgcagtggaaggaagacgctaccacagataatattgcgccccgcttgctggcgaatattttagctctgctaaataatccaccgtatgaatatattgctacttaatgcgtaaaatataatggcccaagaaatttatgggtcattaatcatatatgatttgaatgctttacttctccccccgctttctatattttcgttatatccctgctgtagccgccaggcggcatggcctcttcagtcctcatgatgaggaattttccgtgaacaaaatcccggccttgctgttacttatcttattgaaatgactaaaaatacattcataagagtaattttaaaaccaactcataaatgcaaaatatactatttaatctattattcataatacgaatgaattcggagccagagcgtgagtgataataatcaggcagaaagacaaccggccgatcaacacctacaagacaaaccgcaaattttcagaacactgagaaatattgacctcaatctgttgacgattttcgaggccgtatatgtccataaagggatcgtcaatgcagcgaaaattcttaacctgacgccgtcagccatcagccagtccattcaaaaattacggactatatttcccgatccgctgtttattcgcaaaggccagggcgtaacgcccacgacgtatgctacgcatctgcacgaatacatcagccaggggctggaatctattcttggcgccctggatcttacgggcagctatgataagcaacgcaccattacaattggcacgacaccttcggtcggcgcgctagtgatgccgattatttaccaggccatcaggccgcgttatcctcagcttttgctgcgcaacattccggtagacgatgccgaaagccagcttagtcagtttcagaccgatctcattatcaatacccatagctataacaaccggagcatccagcatcacgtcctgtttagcgatacgcttgagattgtctgccgccagcatcacccgtgtctggcgaacgccattactgaagagagactgaacagcgcggatcacacctttctgatgctggagggacaacatctttccctcctgcgccagcgactgcaggagacatttcccgatcagcaaatcagttttagcagctacaatatttttaccattgcctcgctgatcgccagcagcgatctgctgggactgatgcccacccgcttctacgacttatttagccgttgctggccgcttgaacgccttccctacgcgccggtgaatagtgaacaggtcgagttctcgctgcattacaataaactgagtctgcgcgatccggtgctggagaacgtcattgatatcatccgtgaggcgttctgacaaaaatgttgcattcaggtcacggaagatatgggcaaacagcacaaaacaacaactattttacattttgccgggctgtcaggctgctttatggcccttatcaatgatatactgcgtgtcacaaattcaaaaatagttgataaatacaactttcccttgaattgaaacgctttccttcgttattcgcaactggaacacgcacgctatgagtaaacccattgtgatggaacgcggtgtaaaataccgcgatgccgataagatggctcttatcccggttaaaaatgtggtcacagagcgcgacgctctactacgtaaaccggaatggatgaaaataaaacttccggcggattctacccgtatccaaggcatcaaagccgcaatgcgcaaaaatggcctgcattctgtctgtgaggaagcgtcttgcccaaacctggctgaatgtttcaaccacggtaccgctacgtttatgatccttggcgccatttgcactcgccgctgtccgttctgtgatgtcgcccatggccgccccgttgcgccggatgcggaagagccgcagaaactggcgcaaacgatcgccgacatggcgctacgctatgtggtcatcacctctgtcgaccgtgacgatctgcgtgacggcggcgcccagcactttgctgactgcatcaccgccatccgcgccaaaagcccggagataaaaatagagaccctggtgccagacttccgtggacgtatggatcgcgcgctggatattcttaacgcgacgccgccggatgtgtttaaccacaacctggaaaacgtgccgcgtatttaccgccaggttcgtccgggcgccgattacaactggtcgctgaaattactggaacgcttcaaagaagcgcacccggaaattccgacaaaatcgggtctgatggtgggcttaggcgaaaccaatgcggaaatcattgaggttatgcgcgacttacgccgtcacggcgttaccatgctgacgcttggtcagtatctacagccaagccgccatcacctgccggtacagcgttatgtcagcccggaagagtttgacgagatgaaagcagaagccctggcgatgggctttacccatgccgcctgtggcccctttgtacgttcttcgtaccatgctgatctccaggccaaaggcatggaagtgaaatgatcgtgtaatagacgcttacatttcaggcaaaaaaaaaccggcaactcgccggtttttttactctgcggagcaagcgcattgcgctattactctttatgcgagagtttttcagcctgaacgctaccgtcgacgtctttcttaacgcccgcgtcttcatcgttcattgctttcttgaatcctttaatcgccgtgcccaagtctccgcccagcgtacgtaacttcttggtaccaaacagcagaacaaccagtgcggcaaccaccagcagtttggtaatactaatctcacccatagataccttcttcactaaaaacaggctgcgtaacgcgccggattaacctgagaatattaacggtctttcgacgcgcgcacacaatagcaatctgtaacaaggtgaatcaagctttgcgtaaaaaacatcataataattgcggtggcgcaaatcgtcgttgctgcaaaagaggaagttgctcccgcacctggtctattcgttctctgaatatttccgcgacgatcagcgccggacgatcggctgccgcggctatcgttacccccaacggtcgataatacgactttgaccaatattacgattaccacactccccggccgcaatcatatagcaggtggtatccagcgctctcgccgccagcagcgtcgaccactgctgctctttcaacgggccgcgaacccagcccgtcggcagcgccaatacgtcagccccctgtaaagccagcgctaacgccatatccggaaagcgcaggtcataacaggtcataagacccaccttaaccccctccacgtccagcacaggcgcgataacggttccggcatcaatactttgggattcttgcatcgaaaacgcatcatagagatgcagcttcgcgtaacgcgcgacaatgtgacccgcccgtagcgccaccagcatattaaccgcccgtccaggcgttgacgggacaaggatagtgaatatcgtcgtcatattattatgagcgctttcttccagaagccgcgtcataaacgcgccatccagcggctgcgcggcgcgaatcggcaggtcaaggtcgatgtcatctcgcgctaatatcccctcaggcaacaccagaagcgatacgccgcggcccgccgcctgagccattaacgaaacgcaaacttgcacattctcttcccatacagaactcaccacaaactgcccggctgcaacgaacatatcccctcccacacctctgtcaggactcgccaattatgcgtgttcggcgttacactcctcttgtatagcaattaaataaaggattcggcagtgttacagcttcttttagcagtttttattggcggtggaacggggagcgtagcccggtggatgctcagtatgcgttttaatccgcttcatcaggcgattcccatcggtacgctaacagcaaatttacttggcgcgtttattatcggcatggggttcgcctggtttaaccgcatgacacatatcgatccgatgtggaaagtgctcattacgaccggcttttgcggcggcctgacgaccttttctactttttctgccgaagtggtattcttgctgcaagaggggcgctttggctgggcgctgctgaatgtgctgattaacctgttgggttcgtttgccatgacggcgctggcattctggctattttccgccgccgcagcgcgttaagcgcaaaaaaaacccgccgaaagggcgggttttgaaatcttgctgtcggacgtatgcttacagagcagttacgtttgcagcggaagggcctttggcaccgttagtgatttcgaactctacgcgctgaccttcagccagagttttaaaaccattggtctggattgcagagaagtgtacaaacacgtctttgctgccatcttccggagtaatgaaaccgaatcctttggattcattaaaccacttaacgttacctttaatcttagacatcaaaattacctttacatgaaaaatagacacaaatgctgtatcggataccagtacaacaattgtgatgcattttgtccagtcgaactttgcgaaaaagtgataaatatcgcgttaatttttagctaaccctatctacttattgttttttaaggctttttaattcacaacagaacaatgcccttctccgtcaaaactggaaacgcatccaggcaaaatagacgtttccgttgttatacgaacccggaatgtaggtcatctgaaaggtagcgggaccatagcctatcgacgctaaaggcaacagcacagggatgggaatataattccagttgtcgcgcgcggtaacgcctgcggtaaagcccagtcccagacgaaaattatcgtcttccagcggtcgccaggttttttcccagccataaccgcctatgggttcccatttgttaaatgaatctttaaaggccatcatatagaggccatgccagttgcctttatcgtcccagcgcgactgaccaaaaccaacgccccacggccgttcgttatagcgatccgttttctctttatcgtaggcaaagcgcgcatgccaggtaatggcggggacatacaaatcataatactcaggctgtcgccacgtttctgcgacgttatcggtaaacgtgttaaaccaccctttatccgccgcagagactgaaggaatagccagccatggcataacaaggagagcaataataagaaaatactttctgatgatcatcgcaacatacataccgttcaaaaattcgactgtgataataacaacattaacctgaataaaatcttaacaaactataaacagagaataatctgagagagtatcgggttaacggcgtttgatttagcactcagaaccgtcacgcgctccttaataagctttcacaaaaaacacaaaacaaagcacaacaaataaaacaataaaataacaataaattaatacttatagcgctacagaaaatttgtataaacatatttcatctttagtgatgacatgaaaaaataaccgcgccgtgattttaatcagtaaggcgccatcctttattcggtacatttttataccacttttgtggttcttatttttactctgggtgtcgataagacaggggaaacaatgctaacagttatagagctccttatcggagtcgtcgttattgtgggtgtagcacgctacatcattaagggatattccgccactggcgttttatttgtcggcggtctggttctgcttattatcagcgcgctgatggggcataaggtattacctgccagcgaaaccagtaccggctataccgcaacagatattgttgaatacatcaaaattttgcttatgagtcgcggcggcgatcttggcatgatgatcatgatgctgtgcggctttgccgcctatatgacgcatatcggcgcaaatgatatggtcgtgaagctggcgtcgaaacctttacagtatataaactcgccctacctgttgatgattgccgcctattttgtcgcctgcctgatgtcgctggccgtctcttccgcgacggggcttggcgtactgctcatggctactctcttcccggtgatggtcaacgtcggcattagccgcggcgcggcggcggctatttgcgcttcgccggccgccatcatcctctcgccaacgtctggcgatgtggttttagccgcaaaagcggcggagatgccgttaatcgatttcgcgttcaaaaccacgctgccgatttccatcgccgccattatcggtatggcgattgcgcattttttctggcaacgctatctggataaaaaagagaacatttcacatgagatgctggacgtggcggagattaccaccacggccccggcgttttatgcccttttgccgttcacgcccattatcggcgtactgatttttgacggtaaatgggggccgcagttgcacattattaccattctggtcatctgtatgctgctggccgccgtgctggaattcgtgcgcggcttcaacacgcaaaatgtgttttccggcctggaagtggcttatcgcggcatggcggatgcgtttgccggcgttgtgatgctgctggtcgcggcgggcgttttcgcccaggggctgagcaccattggctttatccaaagtctgatctcgattgccacttcttttgggtccgccagcattattctgatgctggtcttagtgattttaaccatgctggccgcgatgaccaccggttcaggcaatgcgcctttttacgcctttgttgagatgatccctaaactggcgcactcctccggtatcaacccagcctatttatccatcccaatgctgcaagcctcaaacctggggcgcacgatttcgccggtctccggcgtcgtggtcgctgtcgccgggatggctaaaatatcaccgtttgaagtggtgaagcgcacgtccgttccggtcatcgtcggtctgttgatcgtcattatcgctacggaaattatggtgccaggcgcctcttccgccgtcaccggcggctgatagccggtaagccggggcgagggaaaacatcgctccggcatcttaaagcgggcttagccgccgtgataaatacgctgcggcctgcccactttgccatgaataatctctgcgacaatcaggtgccgactcgcgcaatattccaggtagcgtcgggatgtggtgcggcttatcgttaaggcctgcgcgaccgtttcagccgtatggcgtacggttggatcggcaaacagcttcatcaccgcattaagggttaaggcatcaatacctgtcggcaaatcccctttcggttcgccgcgcgcataggcgttgaacatttcatctatctgcttctggcttgcgctatccgcgctcgccagcatacgtctgcgctgttgataacgggtcagcgtctgccccaaacgctcataagcaataggtttgaccagataatcaaacgcgccgctacgtaccgcttccgctaccgtctccatgtcactggcggcggtcgtaaacacgacgccgccgggatagcgcgactgcattaattcatgcagcagcgtaatccccttcccatccggcagataattatccaacagaattaatccaggtttgaaccggtcaatcatcattctcgcctgcgccagattgcccgccagccatatctggttaaagccaggaatatggcggatatattctgcgtgcatttccgccagcagcgtttcatcctcaacgatcaatagggttaatggttctgtcatcgttttttttcactttcggaaggaataaagaaaataaggtgccacaaggatcattgtcttccagcgtaatgaccccgccacagcgccccacataacttgcaatcagatataacccgataccatgctcaccgggttcgtcagctcgggtacttacgccctgctcaaaaattttttcccgcagcgcttcaggaacgccgcagccctggtcggcgacctctatcaccacctcgtcgccctcgtcgctcaggaaaagttcgatggtattgtcgccttcctgtgtacgtaaactcgcctcaaacgcgttatccagcagattcccgacgatggcggcgaactccgtgctatccagcccctccggcagttgatgtaactggctgccgggaacaatcaccatcttgagccccagttcacgcgcgcgctgaactttgccaaacagcaaaccggccacctgacgatcggcgaaggcgccgcgtaaactatcaataagttgctgctgcgcctgcgattcgccctgcaccatctctctgacccgatcatactctttcatttgcagcaggccgttcagagtcgacatccagttcaggtgctcatggcgtagcgtgcgcaggctctcaacatactgtttaatctgggttagctgcgcgttcaacgtcgcgatttcatctttgctgcgaaaactaataatagcgcccagcagctcctcgccggaacggatagcctcacgattggcgatgacgctcaggccattgaagttggccatcacgtcctggcgtctttctgcgatctggcaggtaaaaaagtctgccggattgacgacttccgctatcagcttgcccagccactgacgccccggcgacggcagccccaacatttttctcgcattgcggttaatcgcggtgatatgtccctccggatcaacggcgatcagcccttcataaaccgagctaaataacgcctcctgctggcgtaccacgcgcgcaatctgtttcggctccatgcccagcatttgtcggcggatatgcgcggcgaaaaaccaggaaagcagcattaataccaccagcaacaggacaaaaacccccgccatcggtaataagaagtccagccgccaggagtcgattttactgaccagatagccaattgaaacaacgccgatcacgttgccttcgttgtcaaagataggcgttttggcgcgcatcgccatccctattgagcccttaccggtaatgaaataactttctcctctttccagcgcgccgggtttcgtaaactgcatgggatagccgattttttccggattcggatggtaaagccggatcgagtggcgatcgcctatcaccacatagtcaaaatccgtcccgcgctgcagtttattcgcaattatcgccaggcgtttatagtcccggttttttacggcagcgataatgctgtcgttagaagcaataatttttgcctgattcatcgccatgtcacgaacatgggacgccagataatcttcgaaactggcagacaaatattgtgctaacgctgccacgatgaaaacagaaaccaccagaatgagcagaaaaatacgtaacggaaacgcgagttgccgaaaaaaaggaaacagctttttatttttctgataggacattaaggttccttatgggtatttctctacagatttatcgcaaatgtaataaaaatgttttgagtatcttgaagcatataaaaaccaatcgttacagattccccacattaaatcaattaaacaactaaaacccactgccggaatggcgattaaattaattaaaaaacttaaaaccataaaacacttaaaaaccatctaacgctttgtgaaataaatcaaaatttaccaccaaaatactccttacgatgtatacgtcagagagaaaaataaataactcgtcataaaaatactcccactctgactgaaaagaaaaagttatcaagttgcaacacaacgcaacatatacagaaaagtggcaacaagcatatcaccaggatatttcttactatgtttggcaataatgtattcactcgggtaaaacgctctgaaaataaaaaatggcggagatcgctcactttctcaaagagaatgatttaagcgtcgataccactgtagaagtgtttattaccgtcagccgtgatgaccgtcttattgcctgcggcggtattgccggaaatatcattaaatgcgtggccattagcgaatcagtacgcggtgaaggcttagcgttaacgctggcgacggaattgattaatctcgcctgggaacggcactgcacccatctttttatttataccaaaacggaatacgaagcgctgtttaaacagtgcagcttttcgacgatagccagcgtccctggcgtgatggtcttaatggaaaatagcgcgacccggttgaaacggtatgcggaatcgctggcgacattgcgtcacgagggaaagaaaattggctgtattgtgatgaacgccaatcctttcacgcacggccatcgctatctgatccaacaggcggcggcacagtgcgactggctgcatctgttcctggtcaaagaagatacgtcacgctttccctatgaagaccgactcgatctggtccttaaagggactaccgatatcccgcgcttaaccgttcatcgcggctccgaatacattatttctcgtgcgacgttcccctgctatttcattaaagagcagagcgtcattaatcactgttataccgaaatcgacctgaagattttccgccagtatctggcgcccgcgcttggcatcacacaccgctttgtcggtacggagccgttttgtaccgttaccgcccagtacaaccttgatatgcgtttctggctggagacgccaacgcttcccgccccacccattacgctggtggaaatagagcggctttgcttccaggagacgccgatatccgcctcctgggtacgcaagctgctggttaaacacgatctcacggctatcgcgccgctggttcccgacgccaccctgcgctatttgcagggcatggtcgaacgccatccgggcagcgcggcagcccgtcaaaagtcccccgtattagcaacaggtgaaaaatgaaaataaaccagctagccgtcgcaggcacgcttgagtccggcgatgtgatgatacgcattgcgccgctcgatacgcaggatattgacctgcaaattaacagtagcgttgaaaaacagtttggcgaggccattcgcgccaccatcctggaggtgctttctcgctacgacgtgcgcggcgtacaactgaacgtcgatgataaaggcgctctggactgcattttgcgcgcccgactggaaacgctactggcgcgcgccagcggtattgccgctctgccctgggaggatcgccaatgatttccgcctctctgcaacaacgtaaaacccgcacccgccgcagtatgttattcgtaccgggcgccaacgcggcgatggtgaacaattcgtttatctacccggccgacgcgctgatgttcgacctggaagactccgttgcattacgcgaaaaagacgcggcgcgccgtctggtatatcacgcgctgcaacatccgctttaccgtgacgtcgaaaccatcgtccgcgtgaatgcgctggactccgaatggggcgtcaacgatctggaagcggtcgtgcgcggcggcgcggacgtggtgcgtttaccgaaaaccgacaccgcgcaggacgtcattgatatcgaaaacgaaattctgcgcattgaaaacgcctgcggtcgcgaaccgggcagtaccggcctgttagccgccgtggaatcgccgctgggtattacccgcgcggtagaaatcgcccacgcctctgaacggttgatcgggattgcgctgggcgcggaagactatgttcgcaacctgcgcaccgaacgctctccggaaggcaccgaactgctgttcgcccgctgcgccattttgcaggccgcgcgttccgccggcattcaggccttcgataccgtctattccgacgccaacaacgaagccggtttcctgcaagaagccgcccacattaaacagttgggctttgacggtaagtcactgatcaacccccgccagatagaactgctgcacaacctttatgcgccgacgcgtaaagaggtcgcccatgcgcgtctggtcgttgaggccgcagaagccgccgcccgcgaaggtctcggcgtcgtttcccttaacggcaagatggtcgacagcccggtgattgaacgcgcccgtctggtgctctcccgtgcagaactttccggtattcgcgaagaataaggcaaaaaaatgacgcagaaaaatgaatctcaacgccaggatcgcgtagtagcctggagccgtcacgctgaaagcgaactgagcgcttaccaaagtgcggcaaaattggatctacaagcgcaaaaaccgcgcgaccacaaactgtgcgccagcctggaagaggccatccgccgttccggtttacgcgacggcatgacgctttcctttcaccacgcttttcgcggcggcgatctgacgattaacctggtgatggaaaccatcgcgaagatgggcttcaaaaatctgaccctggcctccagctcgctgagcgactgccacgcgccgctggttgaacacattcgtaacggggtggtcagccgcatctacacgtcaggcctgcgcggcccgctggcggaagaaatttctcgcggcctgctggctgagccggttcagattcactcccacggcggtcgtgtgcatctggtacaaagcggcgaactcaatattgatgttgcgtttcttggcgtgccctcctgcgatgaattcggtaatgctaacggttataccggcaaagcctgttgcggttctctgggctacgcgatggtggatgccgacagcgcgaagcaggtcgtgatgctgacggagcaactgctgccgtatccgcataacccggcaagcatcgctcaggatcaggttgatctgatcgtgcaaatcgaagaagtcggtgatgcaaacaaaatcggcgctggcgcgacccgcatgaccactaatccgcgtgaactgctgatcgcccgcagcgcggcggaagtcattgctcactccggctacttcaacgaaggtttctccctgcaaaccggcaccggcggcgcatcgctggcggtcacccgcttcctggaagacaaaatgcgtagccgcaacattgtggctaatttcgcgctgggcggtatcaccgccaccatggtcaacctgcatgaaaagggcttaatccgcaaactgcttgacgtgcagagcttcgatcgtaacgctgcgcaatctttggcccgcaacccgaaccatatcgaaatcagcgctaaccagtacgccaactggggctctaaaggcgcttccgtcgaccgtctggacgtggtggtactgagcgcgctggaagtagacacccacttcaatgttaacgtgctgaccggctccgacggcgttctacgcggcgcgtccggcggtcactgcgataccgccgtcgcggcggcgctgtccatcatcgtcgcgccgctggtgcgcggtcgcatcccaacgctggttgataacgtcaccacctgcgtcacaccgggctccagcgttgacattctggtcaccgatcacggtatcgccgtcaatccggcgcgtccggagttggctgaacgcctgaaagcagcgggaatgaaagtggtatcgattgagtggctgcgcgaacgcgcgcaactgcttaccggtcagccccgccctatcgaattcaccgaccgcgtgattgctgtcgtgcgttatcgcgacggttcagtgatcgatgtggtgcatcaggtgaaggaataagccacgccactccactggtctcctttaccgtggtggcgccaggcccgatgaaagacagcgcgttaacccgccggatctttaatcacggcgtgactgccctgcacacgctggcagaagagtatggctggaccatccgggagcaggctgcactggcttccgccagcgggccggaagggttgctggcgattgacgcgcccgctcaggcgctcaaacaggcgaccatcgcgctggaacagcgttatccactggggcgcctgtgggatatcgatgtcctgacggcggaaggcgaaatactctctcgccgccatttcgcgcttcccgctcgccgctgtctgctgtgcgggcaaagcgcggctgaatgcgcgcggggtaaaacccacgcgctgactgatttactgactcatatggaggcgctgctgcatgatgccgattcccgtcaacccgactaacgcctccattcagcctcagtcgctgtatgacgcctgggccgatttggcctggcgcgccatgctgaccgaggtaaatttatcgccaaaacccggtctggtagaccgactaaactgcggcgcgcacaaagatatggcgctggcggattttcaccgcagcgcggaggcgattcgacactggctgccgcgctttatggaatatggcgccagctgcacgcgcctgccaccagagtcagttctggcgggcctgcgtccattggggatggcctgtgaagcagcgatgtttcgcgcaacggcgggcgtcaatacccataaaggcagcattttctcgctggggttactgtgcgccgccattggccgcctgtatcagctacgccagccgatcgccgcagaaacactctgcgctaccgccgccgatttttgccgcggcctgaccacgcgcgaactgcgccagaacaacctacagctcaccgcaggccagcggctgtatcagcaactgggattaaccggcgcgcgcggtgaagcggaagcgggctatccgctggtcatccgccacgcgttgccgcactaccgcgcattgctggcgcaggggcgcgatccggaactggcgctgcttgataccttactgctgctgatgtcgcttaacggcgataccaacgtcgcttcgcgcggcggggcggacggtctgcgctggttacagcagcaggcggcggtcttattacatcagggcggcatacggacgcctgatgatctcgtttatctccaccggttcgatcagcaatgcattgaacgcaatctcagcccaggcggtagcgccgatctgctgatcgtgacctggtttttagcgcaaatttcgcaagttaatcattaacacaattatagaaaatatcctttccggagagtcatttatgtctttatccaaagataatatatggaagttgttggccccattagtggtgatgggcgtcatgttgctaattcctgttccagatggtatgccgccgcaggcctggcactattttgcggttttcgtcgcgatgattgtcggtatgatcctggagccgatcccggcgacagcgatcagttttatcgccgtaaccatttgcgttatcggcagcaattacctgctatttgacgcttcagaactggccgatccggcgtttaaagccagtaaacaggcgctgaaatgggggcttgccggtttctccagcaccacggtctggctggttttcggcgcgtttattttcgcgctgggctacgaagtgaccggactggggcgccgcattgcgctgtttctggtaaaattcatgggtaaacgcacgctgacgctcggctatgcgattgtcattatcgatattttgctggcgccgtttactccctccaatacggctcgtaccggcgggactgtcttcccggttatcaagaacctgccgccgctgtttaaatcgtttccaaacgatccttccgcacgccgcatcggcggttatttgatgtggatgatggtgatcagtaccagcctgagctcttcgatgtttgtcactggcgcggcgccaaacgtgttaggtctggagttcgtcagcaagatcgccggggtccagattagctggctgcagtggtttctcagctttctgccggtagggattattttactgatcgttgcgccgtggctctcctatgtgctttataaacctgaagtgacccacagtgcggaagtcgcggcctgggctggcggcgagttaaaaaacatggggcgtctgtcccgcaaagagtggacgctgattggcctggtgctgcttagcttaggattgtgggtttttggtggaaaaatcatcaacgccactgccgtgggtctgctggccgtctcgctgatgctggcgctgcatgttgtgccgtggaaagatattacgcgctacaacagcgcctggaacaccctggtgaacctcgctacgctggtggtcatggccaatggcttaacccgctccggctttattgactggttcgccaataccatgagtacgcatctggaaggtttctcgccggatgcaaccgtcattgtactggtactggtactggtactggtactggtactggtactggtactggtactggtactggtactggtactggtactggtactggtattctatttcgcgcactatttgttcgccagtctttccgctcacaccgcgaccatgctgccggtcattctggcggtgggtaaaggcattccgggcgttccgatggaacaactgtgtattctgctggtgctgtctatcggtatcatgggctgtctgacgccgtatgccaccggccctggtgtgattatctacggctgcggttacgtgaaatccagagactactggcggcttggcgcaatctttggcgttatctatatcgcaatgctgttgctggtgggctggccgattctggcaatgtggaattaaacattacgccaacgtaggttaaaaatgatgccgttcaggttcacctgagcggcattttttatgattaaatgagtaacattcataatgtctataaattatcgaattcatcatgaacacaatatggcattacagtccgctgctggctgtcctcttaaccccgatttttgccgccaacgccgacgaacttcaggcgcaacagtacggtgatttcactgactatgtgctggcgctttcctggcaaaccggtttttgtcaaagccagcatgaacgccgccatcgggaacccgatgagtgccgtctgcaaaaagagccagccaacaaagcagactttctgaccgtccacggcctgtggccaggattacccaaatctatcgccgcacgcggtgttgaccagagacgctggcagcgctttggttgtgcgacgcggccaatcccgaatctgcctgaagtcaaggccagccggaaatgctccgcccccgcccccggactttcgcctgacatcgcgacagcgcttaaggaagtgatgcccggcgcgggggggaattcctgtctggagcgctacgaatatgccaaacatggcgcctgtttcgggtttgatcccaatgcctatttcggcaccatgatacggctggataaggcgataaaagacagcgcgctggggcagtttctggcggataattacggcaagaccgttagccgcgctgagtttgatagcgtcgtcgcacaaacgtggggccaggataatgtcaaagccgttaaagtaaactgccatggcaatcccgcctatttaacagagattcagttttcattaaaggcgtcgatgattaacgccccgctctcctctgcctcattccagccgcagccgcatcccggcaactgcgggaaacagtttattatcgataaagccggttattgacgaagcagaggtttaaaaccgtagccacatttgagaacacgcccgaatgtagactaaaattcactcagggctatgacgtttgaggatttacccgaatgtgaactaaatcacttcaaagacggggtaagtctcagtatcatcatgagagttaaaccctcgccgccagacggtgagggttttcttttgggaccatttacctgcactactcgcagtatcgatgacatggagtaagaaatgtccagacccactattatcattaacgaccttgacgccgaacgtattgatcgtcttctggaacagcctgcgtatgcggatctgccgattgccgacgcgctcaacgccgaactggatcgcgcgcaaatgtgttcgccacaagagatgccgaacgatgtcgtcaccatgaacagccgcgttaaattccgcaatttgagcgatggtgaaacacgcgtgcggacgctggtgtaccccgccaatatgacggacagcagtacccagctttcggtaatggcgcccgtcggcgcggcgttgctgggactgcgcgtcggcgacaccattcactgggaactgccgggcggcgcctccacccatctcgaagtgctggaactcgaatatcagcctgaagccgcgggcgacttcctgcgttaaaccatctgcataagcgttaatgcgtttacacagaggatgcctgcgcatcctctttccgttagctctttcatttctgcctgcttcagacaacgccgcctggcatcgggttgattactcccgtcgcctgtttctgcgccgcttgtgccgacatcgctcccggcaccaggataaccttccggcactcttcttcgcgtttttcgaaaatttcgtagccgcgcgccgcctcttcaaacggcatatagtgcgtgacaatctcctccggcttcagcaaccctttttcaataagcggtaataattcccccagccacgcgtgaacatgggtttgacccattttaaaagttagccccttatcaaaggcgtcgccgaataaaaagccgtgaataaaaccggcatacacgccgggcacgctgaccacgccgccgcgtcctaccgccgcgatacattgtcgcagcgctttgccgctgctgccttccagtttaaggttcgtcagcaccgtctccgtcatgctgcctttcgcttcaaagcctacggcatcaattaccgcgtccacgccgcggtgtcctgccgtctgctcgatgattttttccgccggatcgttctcatcatcgaagttgatcggtatcgcgccgtaacgttcttcggcgaaacgcaggcgccaggcgtggtgatcaacgacgaagatctgctccgcgcccagcagtcgcgcacaggcgatagtcagtaatcctaccggccctgcgccaaaaaccgccacgctggaacgttgctgaatctgggcattttttgccgcctgccaggcggtaggcaaaatatcagaaagaaacagcgctttatcgtcagataacagcggcggcaccttaaatggaccgacattaccttttggcacgcgaacatattcggcctgtccgccgggaacgccgccatacagatggctataaccaaacagcgccgccggcggcgggatctgttttttattcatcgccgcgccgtgtccgtcgttagtgttttcacacgctgaatattgctgtagtcgacagaaaaagcagtcgccacaagcaatgacgaacgggataacaacccgatcccctttccgaatattcttcacatcatgtccggtttccaccacctcgcccataaattcatggccgaaaatatcaccatgttttacctgtgggatcttgccgcgatagagatgcaaatcagatccgcaaatcgcggtggcggtaacacgcaaaatgatatcgtcaggctgctcaatgccgggatcgggtacgttttcaacctttacgtgatgtggaccgtgatacgtcaatgctttcatgcagcctccggggtaacggtgaatgttgcgttcgactataaaagggtagctatcccggagagactaccggaaaaacaggcggctttaggatttttcctggaaaatacacgacttttttaacgtcaggttgtcgcaatatttaaaattgccagacaaatagcagaaagaaacattattatatgcttgaataaattcagtattgattaacagggagtaacgggtatgtataagacaatcattatgccggttgatgtttttgaaatggaacttagcgataaagccattcgccacgctgagtttctggcgcaacaggatggcgtcattcatctgttgcatgtactgcctgggtccgcgagcatgagtctgcaccgctttgccgccgacgtgcgtcgctttgaagaacatttacagcatgaggcggaaacgcgtctgcaaacgatggtgggacacttcagtatcgatccttcacgaattaaaacgcatgttcgctttggtagcgtgcgcgatgtcgtcaatgagatgggcgaagaactggatgcggatgtcgtggtaatcggttcgcgtaatccgtctatcacgacacacctgttggggtctaacgcctcaagcgtggtgcgccatgcgacgctgccagtattggttgtgcgttaaccctggtggctaaaaactgacacgccctgccaggtcacgcctggcagggctttttactgcatcatcgttagtacaaatgcccgatattcacaatagtactcaccgtgtcgccaaaaaagaccagccgactcagaaatacgccaacgaataacaagacgaacaggagtttcgggcgcgaatcaccgtgacggctggcgacaaaagcgagcgcaaggcaaaccaggcttgccagataaaacggggaagccagccatgaacgcgccgtcatctgcatgaccgttcccccgcttaaccacaccagcggcgccgcgataagtaccgcgatacacaccacaattccctggcgtaacgcaggaacggcaggcctgagtcttaacagcggaatcgccgcgcaacccatgacccataccgtaataaaaaataacagcatggtaaatccattagcgatagctaccatcgctggcgcggcgtaggtcatcccctgcaccgccaccagtaacacgccgaacacggaggcgataagagccatcgctttatgtccctttgccaggaacgttacgccgaccgctgcgccaaacaacgtggcgccaaggatttcccgacttaaccaggcatgtcgcaggttaatcagcgcattataagcgcgatcgggatgcgccagatgcagaatcgcggcaatagacgccaatgccagcaccagcccggtggccaaccaatagaaacgctggccttccacttcaccacgcagcgtacgccatgtcagtaccaaagccatcccgacagacatctggcttaataccgtaaaaaacaccagcggcagttcatatttttccattacttgtcctccggctgcttaggctggcgcgccagaataaagcgcgttcctggattgagctgtggcatatgcgggaaccctggcggatactgcaccgcattatcgggcacaggatcggcatccaaatcgataatcgacaaggcgcccaccggacaggcgttcacgcacgccggattcataccgatatcaagacgctcgtagcatatactgcatttttccgctttacgcgtctcttcattaaaacgcggcgcgccataaggacagttacgaatacagtttttacagccgatgcagcgctcagggttatgcaccaccacgccatcttcacgtttggtataggcttcgaccggacaggcggcgacgcaggccggatgttcgcagtggttacaggccagcgagtaaaacgcccgctcttcatgtggatagatgtctttatccaacggataaacgtagcgccagaagcgatccggctccagttggttaaagcttttacacgccatagcacagccgcggcagccgatgcacttatcgctattcactaaaaacgcacgtctcatgctacggattcccctttaccgatcaatacaacgtcagcaaactgactgtggatagcggcgcccggcgcgccagttttcatcagccccatatcagcaggcgtatcggccacgacgttttgcacgttgtactgccgtttcgggaaccacgcttcatacatcaccagaaaatcttccggcacgttggtggtgacttttgcccgcagttccacctcgccaatgttgttgaaaactttgacccggtcattttcgctaatgccttttttcttcgcggaagaaggatggatataaacaaacggttccggatagaacacctgcatccagtccaggttgataaactgcgagtgcaggccaaactgcacgtgcggcgtaaacagatggaaaggcagtttgctctcggcttccggtttgtattccggcagcgcggtgtggccgtttttctccgccagttcagatttaaattcatacttgcctgacggcgttttgaacttgcgatcgtaccaggcggcagagcttggcaggatcgctttttttggcccgtccagcagatcgtcccaggaagagatgccgaacattttcgccataccgtcgttgaactcctgatccagccagcgcttgtgatcgaactcttgcgggaaggtacaggaacccggcgccatcttattaatggtgcgcgacagcatggtagcgatttcaaggtcgcattttgcttcatacatcggcttaatcgccggctgattaatggaaagccagtagtgccagtaagaagcatccacgttccactcttcaaacgcggtggtaacgggcagcacgatatcagcgtgttgcaccgtttcgttgaagaactgatcggcgcagaccaccatttccagtttttcaaacgcttttttcatcttgctgcgatcgaaatcctgggcaaacgggtttttacaggcgacccacagcatacgaaccggcggatcgttggcctccagaatcccctgcgccgtctggttaatattcagagagcgatcggagtactgcacggcgtcgctgccagcggcagccccgaattcactggtggtgcccgccgctcccggtatgccaatagcgcccaccggcggcttctgcagcatggcgttatagttaaagccccaggtatgcagatggccataacgcgcgccgccgccttcgacaccgatgttgccggacatagcgacaaaggcatcgatagcgcgaacgttggcgccgccgttgacatgacgctgcatcccgtaaccaatccaggccgtggccgggttaaccgccgtaaactcttccgccagttgacgaatcacctgtgccgacaacccgcagatttctgccgcccactccacggttacatggttacgcagataggcttcaaattccggatagccatgagcgtcgttgttgacaaaatcctgatccaccaggcccttatccaccagatggcgcgccatccccagcgccagcgcgccgtctgagccaggccgtacgcgcaggtagagatcggctttggcggcagtctgcgacagcagcgggtcgataaccacgaccttcgcccctttctcgcgcgcctgatagatatatttcatggagtgcattgagcaccaggctgggttcgcgccccagataatgatgtattttgctttcaccatatcttccgggtcgttacaccacatgtcgcccatgtcgtagttttgcgcgtcaataccggcaggccagcacggcgtaccggcaaaacgggtggtatagccaagcgaggacatcatcccttcaacggcatagttcagcacgccaaacttaccggaatatttggtcagcgccagaccgagcatagaactgtcttttttcttaatctccagcattttggcggcaatacgctgcatcgcctcttcccatgagatgcgacgccagttgccgctaccgcgaacgtcctgcgccatgggatatttaatacgatcgggactataaacccggcgcggatagctcaaccctttgacgtaaggcgtaccgtgagtaaatgttgattccggcgcaccttccacgaaagtaatgaccccgtcctttacccacgtcttgaggctacaggtgtcatagcagttacgcggacacgcgttacgataaattttgtacgttttagggttaaagggaacaggcggctgcgcaagcgcgcatcgggaggtcagtaatcctccgggtaaagccgcaacggtgcccagcgccactatcccctttaaaaaagaacgtctgttcagatgtcccgtctcattactcatattgatactctcgttttaattcatcaaaccaataaaataagatgtccgccaccgtatataacgtggtcgtttatgcatgagtttttattttttcgatatataatggcacccactttgttaaatagttattgatatattgagtgagggtagagcagtattgtgacgtttgccgggtattagccagtaatagtgtggtcaattccagcacgcaggaaatatgatcgtcaggaatattgctttcctgattaaccgataatcccaacgctgccataaaatcccgtatctccagcgtcgcctttcccatcaccagcgcatcctcttccagatacactgaagcgaaaggcgcagccagcagcttgccagggccgacgaatagcgcattaaagtcatactccgcttccagccacgcccggtcggtaaggtttaccgcagcagatggatttaatctcacgtaggcagatttcagtgaatgactatcatgagaattaaaaaaatcacgcaatgtaagccctgttttttctaattccgtcagtgattcatagattgaatccatgaataaataacctcacatacaaatgcaatataaatcaagaaaaaagaatgggcatgttaacggaagcgcttaatctttctttgataaaaaaacagaaaaattccagttaaatccgtagaagacttttttattgtttcaaagtttaaaaacagaagaccgttgaaataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaccgtctgttattaacagacggtttcagagtattgataatgaagaacgtgttttacccggtggcgttccccaggcataaacaccgcaggcccgaatagcttacactatcgggccatttacgatggccagttaactggccttgcaggtgtgcttacttctttttatgcgattttggtgcgaatcagataatcaaaggcgctcaacgaggctttcgccccttcgcctgtggcgatgataatctgtttgtaaggaacggtggtgcaatcgcctgcggcgaagacgcccttaacgctggtttcacatttggcgtcaataatgatctcgcccatgcggttacgctcaagcacgccttccagccagtgggtattcggcaaaagaccaatctgcacaaaaattcctgccagcgcgacgctatgaatatcgccgctgacacggtcacgatactccagtcccaccactttcgaaccgtcgcccttcacttctgtcgtttgcgcattcaaaatgatatcgacatttttcaggctacgcactttgtcctgtagcacctgatccgccttcatctccggcgcgaactccagcaacgtaacatgttctacaatacctgccagatcgatagccgcttcgacgccggagttgccgccgccgatgaccgccacacgcttgcctttaaataacggaccgtcgcagtgcgggcaataggtgacgcctttggtgcgatactgatcctcgcccggcacattcatattgcgccatttcgcgccggtggcgatgatgatactgcgcgctttcaagactgcgccggacgccgtttcaatctgatgcaggccgccttctgtcgctgccggaaccagtttacttgcgctctggctgtcgataacgtcaacgtcgtaatcgctgacatgcgctttcagcgcgcccgccagtttctggccttcggttttcggcaccgagatatagttttcgatatccacggtatccagcacctgaccgccgaagcgctcgcccatcagaccggtacggatgcctttgcgcgccgagtagaccgccgccgccgcgcccgccgggccggagccgacaatcagcacgtcatacgcatcgcgtttgttcagcgcttccgccgcacgtttttctgcgccagtatccactttagcgacaatctcggtcagagtcatacgtccctggccgaactctttaccgttgacaaacaccgccggaacgcccatcacgttacgttcggtgatttcgttctggaaggtgccgccatcaattgccgtatgtttaatacgcgggttcagcaccgccatcaggttcagcgcctgcactacgtccgggcagttatggcaggagagtgaataataagtttcgaattcaaaatcgccgtcaatatcgcgaatctgctccagcagcgactgcgcttcttttgacggatgaccgccggtccacagcaacgccaaaaccagcgaggtaaattcgtggcccagcggagaaccggcaaagcgcggcccctgctgagagcctggattcgtaatcaggaaagacggcttgcgcaccggcagagtattgtcttctttaaatgtgactttgtcggacagctcggcgatttcagccagcagttccttgatttccgccgatttagcgctgtcatccagcgtggcaatcagctcaacaggtttggtcagtttctcaaggtaagccctgagctgggttttcatatttgtgtcgagcattcttcttccctctctgaaaacatcatcatgcaagccgacttcgcgggactgcattaatgcaacttgcgtcatggtgctgaaatgaaatgggcgcggatgcgcccatgactgaaacaatttccaaagtatttcacgtcagagtaaggcggctagcctgagaatccccgggagcttactgaagtaagtgaccggggtgagcaggcaacgccaacgcagctatggcgtgaaagacgacggaaatttagattttaccgaccaggtctaaggatggagccagagtcgcttcaccttctttccatttcgccgggcatacttcgcctgggtgagcggcaacatactgtgctgctttaattttacgcagcaggtcagacgcgtcacggccgataccttcagcggtaacttcgatcgcctgaatgataccctgcgggtcaacaacaaaggtcgcacggtctgccaggccttcatcttcacgcatgttgtcgaagttacgggtcagggcgccagtcgggtcgccgatcatcgcatatttgatttttgcgatagtttcagagctgctgtgccatgctttgtgcgtaaagtgagtatcggttgagacggaataaacgtctacgcccagcttctgcagttcttcgtaatggtcggcaacgtcacccagttcagtcgggcaaacaaaggtaaaatcggccgggtagaagaagaagacgctccagcggccttcggtatctttctcggtgacttcaatgaattcaccgtttttgaacgcctggtttttgaaaggtttgattttggtgttaattaaggacatctatacttcctccgtgttttcgttgaggagtaagttaacgaaattttgctgattcggctaatgcgtttccattatcaaatcaataagcgttaactaacaacccgattcgggcgacattgtgaacactgcgccctgtcagccatctaaagtaaaaaggccgcctgacaggcggccccattacctgaactacccgtaggtaacttcagagccagtacgactcgtcttgcaaatggcaggcgtattgcctgccactcgaaatccatagcgtatatgctggctaagtgttgcgctctacattaccttaacaaaggctgtaacagcgaaaaggattacatcaccccagcacagaaagggcaatcctggcacgccagctcttacctatgtctgcgataggcatcatcattaatactcttttcgctttgatattaaaaagaaaaatatgattaaacgtacattgctgcttgctatgctgcccattctcgcccacgcggaagaactgcctgcgctggttaaagccattgaaaaacagagcataacaatcctgaaatccttcgaggcgccggggggcatgaagggctatctcggaaagtatcaggatatgggcgtcacgatttacctgacgccggacggtaaacacgcgatttccggctatatgtataatgaaaaaggtgaaaatcttagcaacgccctgatagaaaaagagatctatgcgccagccggacgtgaaatgtggcagaaaatggaaaaagcgtcatggatactcgacggtaaaaaagacgcgccggtggtgctgtatgtctttgccgatcctttctgcccctattgtaagcagttttggcaacaagctcgtccgtgggtcgaatccggcaaggtacaattacgcacattactggtcggcgtgattaaaccggaaagcccggccacagccgcagcgattttagccgcgaaaaacccggcgaaaacctggcatgactatgaagcctccgcaggaaagatgaagctggaggttcctgcgtccatccccccggcgcagatgaaagtcattaatcagaatcagcagttaatggacgatcttggcgctaacgcgacgccagcaatttattacatgaataaagataagattttgcaacaggttgttggtttaccggaaaaagcgcaactggacgccatgatggggcagccttaacgcagaaattagcaaggcagaagcttaaccgtaccacgcccgacagcgctacgtttgtcgggccaaccacctcccggtattaacgcgacgccagaccaaaatgtcatccggcacagcctttttaggctaacggcgtgattatatcagggtacgttatgtccgcctttaccgtaattatttactcgctaaaatattcataactgtggtattttagtttaaataaactctacattaagtttaataaacataattctggtaaattattgagattaagtcataatcatggaagataccatgataatgccgggaagatactatggctaacctttacgaccttaaaaaatttgatcttaacctgttggttatatttgaatgtatttatcaacatttaagcattagcaaagcagcggaaacactctatattacaccttctgccgtcagtcagtcattgcaacgcctgcgcacgcaattcaatgatcctctatttattcgctcaggcaaaggaattacgcctaccgtaacaggcattaatttacattatcatttagaaaataaccttaacagcctggaacaaactattaatataatgaatcagtccagtctgaagaaaaaatttattatctacagcccacagctgttgatcacccaatatgcgatgaaattagttaaatatatccgcaaagatccacaggttgaaattgaacatcacgacattttgaccactgacgaactgcctgaagatctgcttgcctaccgcaaagcagatgttgtggtttcaatggccccacttaataatcgttctattgtttgtactcactttaataggctagaatgtatcctggtttgcagtgaaaatcatccccgactaggcgacaccgccactatcgatgaaattctacaagagtcatttacgcaactcgtctcccgggcaaccggtatgaaagagtatcattcacttatagatgatgtgctgggggagagaataattggtttaagaagcaaatcggtgatgactatcgccaactccatcagctccacggagcttattggttttttaccacaaacatttgttgactattactcttcctctatcaaacttaaaaaagtcgccacaccttttaccattgctcctatacaattctatcttatgtacaatagagcttcgctgaataatagcggatttgctgagctcattgagtacatcacaaaaaagcgttaataaggagatcagagaacgagtaataatataaattaagtgtatacattcgtagaatgtatttacttagagaatataataagacattgcaagttcatataatcagattatcctttatgttaattattgcgaatatattgtagttaacacattggagactatccagagatgtcggtttataaagttccgcttgagcaaaatgttctggaagcggctcaagagcgtataacatggcccctggaaactttaccccgggtctgcgtctcattttctggtggtaaagattcaggacttatgctgcacctgacggcaacgttggcgcgcaaaatgaataaaaagatccacgttcttttcattgactgggaagcgcaattctcctgtactatcgcttatattgaatcgttacgtgaatactacgcggacgttattgagcgtttttattgggtcgcattacccttaaccacacaaaattccctttcacaataccagccggagtggcagtgttggcagccgggaaccgactgggtacgacaaccgccagaagatgcgattaccgatccggcctttttttccttttatcaacacggcatgacttttgaacagttcgttcgcgattttgccgactggttttcagaaaagcgccctgccgctatgctggtcggtattcgttccgacgaatcctataaccggtttgtcgctatcgctaactcgcataagctgcgctttgccgacgataagccctggaccacgttggcccccaaggggcacacctggtatatctaccccatctatgactggaaaaccgcagatatctggacctggttcgccaaaacaggtaaatcatgtaaccccttgtataatttgatgtatcaggctggcgtaccggtccgttacatgcgtatttgcgaaccattcggcccggaacaacggcaggggttatggctgtatcatgttatcgaacctgagcgctgggcggccatgtacgccagagtcagcggcgtactcagcggaggaatatacgccgggcaggacagccatttttacggccaccggaaaattttaaaacccgatcaccttaactgggaggagtacgcgctgctcctgctacacagtatgcctgaagtcactgccgaacattaccgtaataaaatcgccgtttatttgcagtggtataagaaaaaaggcatgaacaccattccacagacgcagcagggcgatatcggatcgcgggatattccgtcatggcgacggatctgcaaagtattactgaacaatgattactggtgccgggcgctgtcattcagtccgacaaaacctaagagttaccagcgttataacgaacgcatgaaagctaaacgccaggaatgggggatcttatgcaacaccgactcacaaccgaaataactcactttctctctggactgcctgaagaggaaaggatcgccgccattaatgaatttagaagggcgatacataacgttagtccttttcgcgatgagccagtcgattgtgtcctgtgggtgaaaaacgatcatatttcgcctaatgactacaacccgaataacgttgcgccaccggagaaaaaattgctgcttaaatcgattgaaaaagatggctttactcagccgattgtggtggtaaaggccaatacggaggaatacgagattgtagacggctttcaccgtcatgagttgggcaaaggaaaagcggtcctgaaaaggcgcctgaaaggttatctgccggtagcgtgtctggacagagaacgtcacgaacggatggcggcaaccatccggcataaccgcgcgcgcggacgccaccagatccacgccatgtccgaaatcgtacgcgaactttctcagctaggctgggacgagagcaaaatcggacaggagttaggtatggacgccgatgaagtcctgcgcctgaaacagatcaacggactgcaggaactctttgcagaccgtcgattctccagagcgtggacggttaaataactacagtttacacaggcgctctgcggcggccagcagcgttgattcctgtttagcgaaacataaacgtataagctgatgcgggaaaggggcggcgcaaaagacagagagcggaatagcggcgacaccgacttcttcggttagccactgacaaaactcaacgtcatttagcgtcgacactgcgctgtaatcgattaacaaaaaataggtaccttcacagggcagcacttttaatcggctttgcgccagcgcgttaaccagcacatcgcgttttttccggtaaaaatcgggtaacgcgcgatagtgttccggcgcggcgcgcagcatatccgccagcgccagttgcgccggcgtattgacgcaaaacgtcaggtactggtgaactttgcgtatttcggcgctaatggccgcaggcgcaacgcagtaaccaatcttccatcccgtcatatgaaaggttttaccaaacgatgaaacggcaaccgcccgctctcgtaactgagggtgcgccagtacgctggcatgaccttcggcggcaaaacaaatatgctcgtacacttcatcgcttaatacataaatttcccgctcgccgatagcctgccacagcgcctcgatatccgcctgacgccagacggtagcggtgggattatgcggcgtattgaggatcaccagccgcgtgcgctcgctaagcaacgccgaaaacgcctgccagtcgacgcgaaaatgcggcggcgtaagcgctatgcgttttaacacgccgccggaaagcgccacggccggggcatagctgtcgtaactgggatcgaaacagataacctcatcccctgcccgcaccagcgcggtaatcgccgcatacagcgcttctgtcgcgcccgccgtgacggtgatatcacttacgtcatcgggtcgataaccatatatttccgccgttttatcggctatggcctcccgcagcgcctgcgcgcccgtcatcggcgcatattgattcgcgccctgcgcgacatgataagccaaccgctcgtgcaaataagaaggaccatcaaaatcagggaagccttgcgataaatttattgcctgatgtttctgcgccagcgcgctcatttgcgtaaaaatcgtggtgccaagattgggcaatttgctctttggaatcagtgggttatttctcattatcttcatacccgccagtgatgtggttgttgacacactatcacagggtgttagtatttggcaatcaagacgtttagatgtctaaatataataacagcggtgagaagaccctaaggacaacacaacatgaaccacactgagatccgcgtcgttaccggcccggcgaattatttttcccatgcaggaagcctcgaaagactgaccgactttttcacgccggaacagctttcccacgctgtttgggtgtacggcgaacgcgcgattgccgccgcccggccttacctgccggaagcgtttgaacgtgctggcgcaaaacatctgcagtttaccggccattgtagcgaacgccatgttgcccaactggcgcacgcctgcaacgacgatcgtcaggtggtaataggcgtcggcggcggcgcgctgctcgataccgccaaagcgcacgcccgccgtctggcgctgccgtttgtcgctatcccgacgatcgcggcgacctgcgccgcctggacaccgctttccgtctggtataacgacgcgggacaggcgttacagttcgaaatttttgatgatgccaattttctggtgctggtcgaaccgcgcattattctgcaggcgcccgatgactatctgttagctggcattggcgatacgctggcgaaatggtatgaagccgttgtgcttgcgccgcagcctgaaacgttgccattgaccgtaaggctgggcattaacagcgcgtgcgctattcgcgatctcctactgaccagcagcgaacaagcattagcggataaacagcagcgtcggctgacccaggcattttgcgacgtggtggatgcgattattgctggcggcggtatggtcggcggcctcggggaacgctatacccgtgtcgccgccgcccatgcggtacacaacggtctgaccgtcctgccgcaaacggaaaaattcctgcacggaacgaaagtggcttatggcattctggtgcaaagcgcgctactgggacaagatgacgtgctggcgcaattgattacagcgtaccggcgatttcatctgccgacccggcttagcgaactggacgtggatattcataacaccgcagagatcgatagggtcatcgcgcataccctgcgcccggtcgaatctatccactatttaccggtgacgttaacgccagacaccctgcgtgcggcgtttgaaaaagttgaatttttcagaatatagcctggtggcgttgcgcttgtcagacctggcaaccatcagcagcaacgcgcgccgccttttccaccatagcgcgcatcctgccgctcgcggaaaaattcttcataggtcatcggcgtctgatccggatgcgttatgcgcatatgttccacatagttgtcgtagtctggcacgccaatcatcatttttgctgcctgtcccagatattttccggctttcgaaagcgtatcgaacatcgttgtcacctgtcatccaaacgccctctccttattctggagagggctattgatgaaaaaagattagtgcgcgcctttcgcttgcgtcacgatctcatccacattttccggcatcggctcatacggcgtttcattcgccgtcggtttatcaatcttcagagcggccagcgccgtcttaatagagaagaccgccagcaccacgaccaccaccataaagaagatggttagcccggcatccagacggttattgaataccaactgcgcgagctgcgattcggtgtactgcggcggaatattgccgctgtcgatcatcgcctggaatttattggcaatggccaggaagccgattttcgcatccggactaaacgctttctgccagcccgccgtcagcgtacaaatcagcagccaggccgtcggcaccagcgcgacccacgcataacgctgacgcttcattttgaaaagtaccacggcgcaaagcatcagcgccatccccgccagcatctggttggcgatgccaaacagcggccacagggtgttaataccgcccaacggatcgaccacgccctgatggaggaaatacccccacgccagcacgcacaatgccgtagcaagcaggttcgctggcagcgaatcggtacgtttcagccctggcgacactacgcccaacaaatcctgcaacataaagcgcgccgcacgggtacccgcatccaccgccgtcagaataaacagcgcttcaaacagaatggcgaagtgataccagaacgccacatccatcatgccgcccaacgcgccatgtaaaatgtaggccatccctaccgccagcgttggcgcaccacctgcgcgggagataatggattgttcgccgacttcattggcaatctggtgtaacgtatccggcgtgatagcgaacccccaactactgaccacctgcgcggcagaagctacgacatccgctgtccccgctggcgccagtaccgccatcgggctattcatcgcaaagtaaacgcccggatcgataatacaggcggagaccagcgccataatggcgacgaaagattccattaacatcccgccgtagccgataaagcaggcctggccttcgttggccaacatcttcggcgtcgtgccggaggagatgagcgcatggaaaccggataccgcgccgcaggcgatggtaataaacaggaacgggaacaggtcgcccgtccagacgggtccggtaccatcaacaaatttggtcagcgccggcatggtcagcgtcggacgcataatcagaatcccgactgccagaccgacaatcgtaccaattttcaggaaggtagagaggtaatcacgcggcgcgagcagcagccagaccggcagtaccgccgcgacaaaaccataacccaccagcatccaggtaagctgcacgccagtaaaatcaaagtacggcgcccaggttgggcttgccgccacccatcccccggaaataatagcgaaaataagaaataccagcccaatgaccgacacctcgccgatgcgccccggacgcagataacgcagatagatgcccataaaaatcgccagtggaatagtgaacgcgacagtgtacgttccccacgggctatgggtcagcgctttcaccacgatcatcgccaggacggccagaatgatcaccatgatcataaagcaggctaccagcacgatcacccctgccgtcgcgcccatctcctctttaaccagctcgccaagcgaacgcccatcgcgccgggtcgagacgaacagcaccataaagtcctgcaccgctcccgccagcacgacgcccgccagcagccagatcatccccggcagatagcccatctgcgccgccagtaccggcccgaccagcggacctgcgccagcaatggccgcaaaatggtgaccgaacagcacttttttatcggtcgggacataatccagaccatcattatgacgtaccgcgggcgtcatacgcgttgggtcaaccgccagcacttttttggcgatatagagcccataaaaacgatacgcaataagatagacacagaccgacgccaccacgatccatagcgcgttgatctgttccccacgatttaacgcaatatagcctagggcaaacgcacccaatactgagagcgctgtccagacgaggtatttccctgatttattcatagttgttgtccgtttgggtgttccagagagatgttacattttgtttctatgacacctttaccgtaattaacaacacaacaacatgataaaaccggattgttacccattttttacattacagtgttaaccagatcacttcctttcttcgttaatgctgcaattgcattttactttgccagaactatcccattaccgccgttcccaggcgacaagtgcagcagcgcctcccctgctcgtcaaagagcgtaatttcccagctttgattctgccgccccagatgcagcggcaggcaaacgccgcgtactttcccctgcgagacggcgcggtgatgggtggcgtttaactcggtcccgaccacgcactgcccgtcgcgggtcatcagataacccgccattgatcctaacgtctccgccagcgctgccgatgcgccgccatgtagcagaccaaacggttgatgagtgcgggcatcgacgggcatttccgcctccagcacgtcatcgcccagacgggtgtaaacaatgcccagatgcgccaccagcgtgttctgactggtagcattcaattcatccagcgttaaatgccgtttccagatcatcgtcaggctcccaatgttgaaccgccgtccaccacgatatcctgcaaggtaatgtggctggccagatcggaggcaagaaacaaaatggtattggctatctcctgcggacgggcgattttaccgagcggtatgccgagcttaaactgttcgccgaaaccgcgaatgcgctgctgttcggcatcttcactcacccataacgtgcgctgcatatcggtgtcggtcgagcccggcgacaccacattacagcgtaccccgcagcccgccagctccagccctacggttagcgccaggcttttcagcgccgctttagaggcgccgtaagcgcccataccgatacgcggcgtatgcgccgcatctgaggctacggtgacaatcgcccctccctgctgacggcgaaactgcgccatcgtctgggaaaacaggttaaatgccccgcccacattgaccgcaaatgtctgctgccagtcgtcgacgttaagcgcgtcggtcgctcccatacgcaaaataccggcggcgttgaccagcacatccagccgcggcgttttttgcaacacacgctggcacacctgcgcaacctgtgcggcatccgccacatccataacttcggtagcaaagggataattctcttgcgtaaattcgcgatcgaagccgatcacccgcgccccggcgtcgacaaacgccagcgccgtcgcgtaaccgatccctttccccgccccggtcacccataccgttttgtctgaaaaatcaaagctggccattactctaccccgcgagaaagcagcgcccaccaggcgtcaatggtcggatttttcgccagcatcacgaagtcgatatcgccgtgtactttacgccagcgcgccgccagccccatcatgcgtactgaatccaggccataatcaatcaggttttcatcatccagcggctcgtcggtctcatccagtaacggcagaatcaacgcccgcagcgccgctttactggcaggaatcggcgtcggcagcagcgactctgtcatgacgacgcgaccggaacgccccgccacatagttcagcgccatcagatgctcttcccgactgaaatccgccagcgcatccgccaccataaacggcttaatgtcgcgcataaacgcatcggtagcggtggtcatacagccaatatgtgcatatacgccggtaatgatgagctgattgcgtccggtatcttttaacatctgttccagcggcgagcggtgaaacgcgctataacgccacttcaccagcaccgtatccgcctcatccggcgttaaggcttctaccaccttctgctgttccggagagcgcgtcagtcccggtccccacatatcattgagtaacgcgcgatcttcatcgctttgctctttcggctgagcggtgtaataaaccgggatatgatgttccttacagtactggcgcagagcggcgatattggcaattacctggtccatcattgggcaattgcggccccaaaagctgacaaagtaatcctgcatatcgtggatgagcagcgccgcgcgctccggctcaaatgcccagttcactttgttggtcgggatatccagtgcggtgggcagcgcgtaagactgtagtttcgggattgccatctctctttctccttcagagcggtgaacgtgacgccaaccgctggcgtaattgttttttatcgactttaccaaccggcgtcagcggcagtgacgcaacgcactccacgcgatccggtaatttaaattccgccacgccctgctctcgcaggaaacggcgtacctgtaccgctcgcagcggctcttttaccaccagatatgcgcaacttttttcccccagcagttcatcttccatgctgaccagcgccgcatggatcaccgccgggtggcgcagtaacaggttttctatctcttcggcggctatcttctcgccgccccggttgatctgatctttttcacgcccgtgaacggtgatgtagccgtcttgatcaatggagatcagatcgccggaacagtaaaaaccgttggcgtcaaaggcgctgacattgtgttgcggactgttgaaatagccgcgaaaagtataggggccgcgcgtcatcagacgaccaatctcgcccggcggcagtggattcccgtcggcatccgccacccacacttcgtcgtccggacacatgggtcttccctgggtattgataatccgttccgggctatcgtccagccgggtatagttcactaacccttccgccatgccgaagacctgctgcaactgacagccaatttcagccggaatacgggcggccagcgtcgcagaaagccgcgcgccgccaacctgcaataaccttaatgacgccagcggcgcattgccgccccactcctggatagcctgtagccatagactgaccgcgggcggcaccagcgccgtggcattaatctggtgtttttcgatcagcgggaaacagagcgtggcgccaggatcggtcgccagcactaccgttcctttggcgagaaaaacgcccagcgcgcccggcgaactcatggcgtagttatgcgcggcgggaatcgcgcacagaaaacgcgtctcctcgttgaaaccgcaaatctcattgctgcggcgcacgctgtagtaatagtcgttatgggtacggggaataagctttggcgtgccggtagtaccgccggaaagctgaaagtaggccacttcgtcagcaggtgatggcgtggcggtgaaaccttccgccgcctgccgcatcgccgcgtccaggctgtgatcgccgtcgtcgttgcgcaataacaccacccgcgcagagcggtgttcagccacaaacctgttgagaaagtcctccccggcgaacagcgtatgttggcgatcggcaatcaccagcgtcggcgcgatctgcatcgcataggcgttaagttcggtacgttgatggctaaacagcgccagaacgggcgctacgccaagcttcaacagggcgaaaaaggtgatatacagttccggtacattccccagttgtaccagagcggtttcgccaggtttgatgccctgacggcgtaaactgcaggccagattatccgcggcctggtttagctggcgatagctgaatgcgcgctcgccttcaatgaccgccgtcttatcgctgtcagcgtggcgggtcagaatatcggtcaacggcacgtcttgccagtagcctttttcacgataacggcgggcaaattcatccggccaacgggtgaaaggtatacgcatcatcgttccttaatgcagtccaaaaacgttcaacatcgtagagagcttgacgccggtttcccgccactcgccgactggcgaagaggcaggaacaatcccggcgccggcgaacaggcgcacctgattaccgtgcaatttcgcacaacgaatcgtcactacccactcgccgtttccttcggcatcgcaccagccgacaatgccgccaaacagttcacgatcgaacggctccagttcagcaatcagctttttcgcgacctgatgggggaaaccgcttaacgcaggggtcggatgcagcagacaggccagcgtaagcgcgttttctccggcgttggccttgccctcaaacggcgtaccgagatgccatagcgtcggcgtggtgatcaactgcggagaggaaggtaattgcagttccgtgctgcgatcgcgcaggatctgcttcatcgcctgcgtcaccagctcatgttcatggcgatctttttgtgaagccagcagtcggtttcccgcctcgcgatccagaacgtcatcgggctgtcggcgtgccgagcctgctaacggcagcgaactaaaccgctcgccctccttgcgtagcagcaattcggggctggcgcccagcagaacgccgccatccgccagtggcacatggaagttgtaactaactggattctgcgcaaccagccgctccagcaatgctccgctatccaccgccacatcagtggtgatatctatcagccgggaaagcaccactttatcgacgtctggcgtggcggtcagcatagccgcgcgtgcgaccatcgcttcaaaagcatcctgctccggaatcgcctttcgcgccgtcaccgtcagcggctgatggtcagtaaaataacgcgccgtgcgctgcttttgctggcgggaaaaggactgccacgccatcgggataaatagcgacgacggctgacgggtatcaaaggggatcgcccccaccaggatagggttggcgatgccctgcgatttggcctcggcaaactgctggcgcaatttctgctggaaagggctatccggcgaatctccggcaaccgcaggctcggtataacgggcgaagcacccggaagtggtaaaactgcgatacggcgacatgaagaaaaagcgatcgggagcaagcgttgccattgtctcctgagcgtcctcggccagtgacatatccatatcatcctccaatgataaaggcttatatacacttcatctttcaagctgcctctttgttggctgcgatcagaaaccccggtcacacagttatctatgcccgcggggattcttcccttgccgtcgcgatgcttcttgaatgattttgtgtataataatgattattatttctatttttagtgcgctaacctaagagtaaaacgtcgctctgtcaactctggtcatgagttaaatggcactaaggcttgcatctcgctgccgctgacatgaaaatgagaagcattaactttattaataacaggacgctattgtgagactctccgccttttatcgttggctgcttttagtggttggtttatcaatttcaggaatatccttagcccaggacgccggttggccccggcaaatccaggacagccgaggcgttcatactctggaccacaaacccgcgcgtatcgtctctaccagcgtgacgttaacaggctcgctgctggcgattgatgcgcccgtcgtcgccagcggagccactacgccgaataaccgttttgccgacgatcaagggtttatgcgccagtggagcgatgtagcaaaggctcgccatgtcgcccggctgtacatcggcgaaccgaatgccgaaacggtcgccgcgcaaatgccggatctcattttgattagcgccaccggcggcgactccgcgctggcgctttacgatcagctctccgccatcgcgccgacactcgtcatcaattatgacgataaaagctggcagagtttgctcacgcagcttggcgagatcaccggtcaggagaaacaggccgccgcgcgaatagcggaatttgaggcgcaactgacgacggttaaacagcgaatcgccctgccgccgcagccggttagcgcgctggtgtatactcctgccgcgcatagcgccaatctgtggacgccagaatcagcacaaggcaagctattgacgcagttaggctttacgctggcgacattgccccaagggctgcaaaccagcaaaagccagggtaagcgccacgatatcattcagcttggcggtgaaaatctggccgccgggttaaacggcgaatctcttttcctgtttgccggcgacaacaacgatgttgcggccctttacgccaatccgctgctggcgcacctgccagcggtgcaaaataagcgcgtctatgccctgggtacggagacgttccgtctggattattacagcgcaacgttgctgcttaatcgactggccgccctgttttagccttatcggagtcttatccgactgaccagacagatttggtcagtcggataaacgcgtcttcatcagccagcatcgctaaccggcggcgtctggcgaaaacggcgtagctcgcccagcactaacagcagcagcaaaccgataatcaccagcccgaatccactcacgctcgcggaagcgaccggcgtcatcattgcgccaagaccgcctaacagcgccgcgccgatagcgtctcccgtgacgttttgcgcggtccacaggccgttcattcgccccagcatattttccggcgtctgggtttgcagcagagtgtattgtaataacgaactgatggcgctaagccagccaaatagcgccagacagataacaccagcgatccagatcggcatgatggcgaacagccccaccgccagaaaagaaccgactgtcgaaaccagcataatgagccccggacgaacgctatgcgccagttgtccgctggtcagcgcgccaatggccgcccccagcggaattgccgcatacagcaaaccgatttgcgccgccgacatctgccagctcatcgccagcgccggatagaggacgcgtaccgcgcttgccatcgtcaccaggccgccaagcagcgcaataccgccgataagcggactggcgagcaaaaaacgaaatgccgccagtaacgcgataaatggattttcccgcggctgcggaggaacaggcagtcgcggcagcgtcagtaacggcaatagcgtaataaacgtcccggcggccgccagcccatagttccaggctacgccgccgctggcaagcaatatgccccccaacatcggcgaaataaccgatcccagacgtaccgtcagcatggtaatcgcgccggcctgcatcagattttctcttccgaccagcgctggcgtcgccgccagtaacgcggtcacgcccagagacgcgaaaaagccgtcccacaggccaaggagatatatcgccagcaatgacggttccggcagcagcgcgttcacgcacagaccaataaagccaataccgcaagtaccgcgcgccagcagaatcacctttttgcgttcgtagcgatcggccagtacgccgcccaccattaagccaataaacatggcgccgccggttaacgttaccgacagccctacctgccaggtagagtgcgtcatcatttggatctgtaccggaaccgccacgccaagcagccccagcgagacaatagagataaaacgggccagaaatactgcgcgaaatgcagggtgcgtcttcaacaggctgagattgagcagccaggattgtcgattcattacaacgccttaatgcgagtttttttaaatatccattcaatggctgcacatgctaatataaccaaataagatagataacgataattactatcattatcagggaagttactatgtcatgctcgttttccgtgacgcgcgcgtttgccgtgcccggattgttgttattactgagtctcgccgcggttttaagcctggtcattggcgcgaaaccgctgcccgccgccgtcgtgctggaggcgttcaccggcgtgtgccaaagcgccgattgcaccatcgtcctggatgcgcgtttgccgcgtacgctggccggattactggcaggcggcgcattgggtctcgccggggcgctcatgcaaacactcactcgtaacccgctcgccgacccggggattctgggcgttaacaacggcgccagcttcgccattgtactgggcgcggcgctgtttggtttctccacgccgctggaacagcttttcatggcatttagcggcgcgcttatcgcatcgctgattgtcgccttcaccggtagtcagggcggcggccaattaagcccggtccgcctgacactggcgggcgtggcgcttggcgcggtactggaaggactaaccagcggcatcgcgttgttaaatccagaggtctatgaccagcttcgcttctggcaggcgggatcgctggacattcgtagcctgcaaacgttgaaagtcgcgctcgcgcccgtggttatcgctgggatcgtggcgctatttctgagccgagcgctgaacagcctgagcctcggcagcgataccgcgacggcgctggggagtaaagtggcgcgcacccaacttattggtttactggcgattaccgtcttgtgcggcagcgcaacggcgctggtcggccctatcgcctttattggtctgatgatgccgcatatggcgcgttggctggtgggcgcagaccaccgttggtcgctgccggtaacactactggcaacccctgctctgctgctttttgccgatattattggtcgtctgttagtgccgggcgaactccgcgtatcggtcgtcagtgcgtttatcggcgcgccggtacttatctttctggtacgccgtaaatcgagcggaggcggcctgtgatgtttctttctcgtcggcttatcgtaagctgcctgcttctggcggctggctgcttcgccattggcttatggagcctgcaaagcggcgccgtgccccttgagaccgggcagattattgccgcgctgctgggcgacgcgccgcgtaatatcacccttgtcgtaaccgaatggcgactaccgcgcgtattaatggcgctactgattggcgctgcgcttggcgtcagtggcgcgatttttcagtcgttgatgcgtaacccgctaggcagccctgatgtgatgggctttaataccggcgcctggagcggcgtactggtcgcaatggtcctgtttggccagcatcttaccgcgatcgcgctggcggcaatggcgggcggtatcgtcacgtcattgattgtctggctgctcgcctggcgtaacgggattgaaactttccggctgattatcatcggtatcggcatccgcgcgatgttagtcgcctttaatacctggcttctgttgcaggcgtcgctggaaacggcgctcaccgccggcttatggaacgccgggtcgctcaacggtctgacatgggcaaaaacctggccttcggcgccgctgattatggtgatgctgacaggcgccgcgctactggtgcgtcgtatgcggctgctggagatgggcgatgacagcgcctgcgcgctgggtgttagcgtggagcggtcacgcctgatgctgatgctggtggcggtgtcgctcaccgctgctgcaacggcactggctggccccatctcgtttattgcccttgtcgcgccgcacatcgcccgtcgtcttagcggcacagcgcgctggggattaacccagtcggcgctgtgcggcgcgttattactactggccgccgatgcgtgcgcgcagcaactgtttatgccttatcagcttccagtgggcgtggtcaccgtcagcctcggcggtatttaccttatcgtcttgttaattcaggagtcccgcaaaaaatgaccgaatccgtagcccgtttgcgcggcgaccagttaacgctgggttatggcagctataccgtcgcaaaaaaccttaatgtttcgattccggacggccattttaccgccatcatcggccctaacggctgcggcaagtcgacgttgctacgtacgctaagccgtctgatgacgcctgttgacggccatgtctggctggatggcgaacaaatacagcgttacgccagtaaagaggtggcgcggcgcatcggattgctggcgcaaaacgccaccacgccgggcgatatcaccgtacaagaactggtcgccagagggcgttatccgcatcagccgttatttacccgctggcgcaaggaagatgccgacgccgtcgccagtgctatgcgtgcaacaggtatcacctcactggcggcgcaaagcgtagacacgctgtccggcggccaacgtcagcgggcgtggatagccatggtgctggcgcaggaaacgtccatcatgctgctggatgagccgacaacgtggctggatattagccatcaaattgatttgttggaattgttaagcgatctcaaccgtgaaaaaggctatacgctagccgccgtcctgcacgacctgaatcaggcctgccgatacgccacacatttgattgcattacgcgaaggtaacattgtcgcacagggcgcgccgaaagagattgttaccgctgagcttatcgaaaaaatctatgggctgcgctgtatgattatcgacgatccggttgccgggacgccgctggtggtaccgctggggcggcgatagtcgcccacacagatgacaaagccggatatcgctatccggcttttcgggtaaatcagactaaccgttcatctatcgccagcgcgttttccattttacgcgagaccatcgcgtgacgcagtaatacgccgccgcaggccatcataccgccaatcaacgccgccaggataataatgatcgctttacccgggccatcttttttcactggcagagacggcgacagttgatatttaaacggggtaaacttcacgtcgctcacattcattgccgccagttgttcaacatagtattgacggttacgcaaatcaccgtcgatctcggccacgtccgttacccctttttcaatttccagtttgcgggaaataccatccgcgccgagggaaatagaaaaatccggatcatcttttaccgcctgaccattactgtaaaccggtctcttaatgccagcggcgttggcgatttccagcgaataatgaagacgttgaatattggcatcaagctgatttttgagacgcacccgatccatcgccagcttttcctgctcgtagcgggttttgatttccagctggttacgaatattttccagcgtctctttcacgacgatatcggagatgtactgaatatagccagccaacactttttgcgcttcttcccgcgtcggcgcggtaaaactcagcgtccacgacgtgaataacgacgtttcatttttcttgccggcattgctgtccaccgctttcattttttcgctcagcacgacaatcgcccggtgaagatcctgctcgtctatttgcgcgccttttaattgatccatgacatacggagaagaacgaagatattcttccagcagcgagggcgagctaaactttttaataaacagattaaatacgctggcccgatcaacgcttacctccatatccaacacgcgcagcgcggtcaacgttctctccagcccctgctactgtaccgactccgccggtgtgacaatcgcctggctggtccatttttgcggcagcagaaaggacagaagcaaccccacgcacgcaaaggcgaaaacggtagcaagaatacgacgtttcgcctgccataacacctctataaggctaaacaaatcgatttcatgactgttggcgggcggcagtgagtaacctgcaaatgactgatttttctcttgttttacattaagagatggcatgccgtatgacctgaaaactttatccaatgaaagaacacattcctgtcagagattctaacagcaagtcagaattatccgaaacaatctttacgcgccagtgcccgaaaagctaaatattcggaattaaacttgcctgtagcatgtatcacttatgttaaaagaattaatagttgcaataaaaaacccataataattagtcattattatgggtttcaggatttaatttgttaaaggcagaaacaacgcccgttatttattaataagttcgctgatgatgggcccgatagtttcaaaagcggagggagaaataatatctacatgcgcgcacggctggcgataaatagccaaagacgctatccacggcgaccagctctgttcaggcgatacgtcttccggcaccgttttatccgccacaaagagcgtggcatgtccatcaaacggtgcgctatgcgccgtcgtcagcaaacggacggcatccgcataattgccttcaatggcggtaaataaggcgtcggaggcatttccctgctgcgcggcgacaaacgctgcgcgttcgcgttcaatttccgccaatacgtccggattgaggccattcgcctcttttccccgccagttttgtgtttccggcggccaggtgtccagtaaccccaaaaacgccaccgtttcaccgcgcgcgcgcaaccgggcggcgatcccttgcgccagcgtcccgcccagcgaatagcctaataaataataagggccatgcggctgccgggcgagcaatgtcgccagatgatgttcacatacctcatcaagggtggttgcgatttgcatagggccaacggggcgcggcgactgaatccccataatcgaccacgacgggctgagatagcgtgataatacgctaaattgccaggcgaaccccgacgccggatggaaacaaaataacgttggaccatcgctttcacgcagcggcaacagcggcccgaaccccagattgcgcgagcgttcgtcatcgtcagtatcgagcagcttactcaactgcgccacgtcagacgccaccatcacctgccccggcgtcacctggcggttaaacgtctggcttagctgcgcggccagtttcatcgccagcagcgagtgtccgcccagcgcaaagaaatcactttcaacgtcgttaatctcacagcccagcaggcgggaaaacgccgcggcgacagcaatctccgttgcggactgcggcgcacgccctttcacgcgcggcgtcagatccggcagcggcagggctttgcgatccagcttgccattagcgctaagcggcaagctggcaagttgcaacagcacaaccggcaccatatgcgcgggaagtttttggcgtaatttatcctgcagcgccggtaaatccagcggtaaaccggagtgcgacaccagatagccgaccagttgccgggcatccccgcccgtcgccgccgcctgattaaagacgcaggcatgtgctaccgcctgttcaacatccggcagcgtttgcatgacgcggtcaatctcacccagttcaatacgttgcccccgaattttgagctgatcgtcgctgcgtcccaggtactccaccacgccggaatccagccagcgcgccacatctccggtacggtacatccgttcacctggcgcaaaaggatcggcgataaaacggctggcggtaagatccggacgccccagatagccctgcgccagttggataccggtaagatagagatcgccagccacgcccggcggcaccggctgcatatgcgcatcgagaatacgtaaaccggtattccagacgggataaccaatcgggatactgttgccgtcaacagccgccagctcatcgccacaggccggataccagctcacatccaccgcggcctccgttggcccgtacagattgtgtagcggcgcgttggttaacgtctcccattcgcggcacagcgccgtcggcagggcctcgccgctacagaaaacgcgctttaaggaagcgcagcttttcccagccgacgctggcgtgagcgaggcaataaaggccgccagcatcgacggcacaaaatgggtggtcgtgacgccgtattgcgcaaagaaccgctgcatcgcgagcggatcgcggtgcgcttccggttcagccatcaccagtttcgccccggcgataaacggccagaaaaactcccatactgagacgtcaaaactgcacggtgttttttgcgctactacatcatccgccgtcaacggatagtgatcctgcatccacagcagccggttgactatcgccgtttgtcccaccatcacccctttcggcctgcccgtcgaaccagaggtgaaaatgatgtaagcggtatgatgcggtagcgacagccccagcggagtggcgtcactgaccggtagcggttggctataacacaaatattccatccccggaatatcgtgaaagcgcgccagctgcgcctgagtcgtaattaacagtttcggctgcgcatcttccagcatcattcgcagccgatcgtcaggataaccggtatccagcggcagccaggcggcgcccgcttcgacaatgccgtgcagcgctaaggtcagaaaaaccgaccgcggcaacgccaccgccacgctatcgccaggctgaacgccgcgttcccgcagcgcgtatgccagcgccacaacctgttcgcgcatttcacggtaggtaaagtgataatgcgcatctgccaacgcggaagcctctggcgttttttgcgcctgctgcgccaccaaatcgctaagcgtggcggcgggaatcgttaccgccgtattattaaggtgtgttaattgcgtttgttcttccgccagcagcatttgcgcatcgccgcagcgcagcgccgggttatcagcaaactgcgtgataagcgccatcaaccgtaaggcatggcgggaaagcgtggcgtcatcgtaacgctgcgcattcgccagcaattcaatatccagaccgccgttttcatccggaaaaagcgccagttcaagatcgttaaccggccccgtcgccagggtatgggtttgcgcctgtatgccaggaaaatccagatgataatcaaatacttttatgttgagcaccgggccaaatagcggcgtttcccctgcggctcgcccgctatcgcgtacaatctgttcggcgtcgtaacgctggtggcggcgcatcttctttaactgcgccgcaagacgcttcgccagcgttggcagatcttccgtcgcatgaaggttaaccgccagcggcaacacgttaaggacaggcccggtcgccgttaacgccgctgagcccatccgccgcataaagataaatccggcggcataatccatacgcccacataatcgtcccagccacaacgtcaccagcgccagggcaagatccgctcgcggtatctcaggcatgtgcgccgccagttggcgaaacgcccccgccggcgcgctcaatttcatacgcagaatatccgcgctcgccgaccgccccggcaacggcgcggcagacattgacgccggcggcggcagctcgcggcgctgctgcgcccagaaggcgccgtcacgctgccaggcctcgctctggcgatagcgctgatattcctcaaccacatccacaaagggggtaaaaggcgactccggcgtaggggcgtcgctctgccaggcgcgataaatcgccgcaatctggcgagttatcgccgggaagctaaagccatccaccagcaaatggtgatagcgctgataccaataccagcgggtatcatcaatgcggattaactggtgaaacgccagcggcttaccgctatctgcgcgcaggttttgccgtaaatccgcctgcattaacgccagcgccgcgagatgcggatcgggctggtcgcgtaaatcggcaatcgggggttcgccgaaggtgtgctcagaatctatccattgccagacctcgccgttctcttcggtaaaacgcatccgtagcgtatccgcctgttgcatccctaccgctaccgcttttgccagcaagggggcatccagctcgccattcagttccacatagtgcgccacgctccaggcggagggtaaatcagagagtttttccgccatccagatccccggctgggcggcgactaacggtaaacgctgcgtcatttcgcctcctgcttatcggcataatgcgccggattcagtgttgtccagcgcgtattaagccactgctggcacgcgtcctgcgattgcggttcgcataccacgccccatcctgcgggaagcgcgcacgccgctggccaaaggctgaattgacgctgcgcattttgcaggatgtaaaactgtccctgcggattatcgaagggattactgaattccatactcaactcctgtcatggacatgtgcccggttaaagcgtgtcgataagcggctgccaaagcagcatcagcccttgcgttagcccgccgcgccagcaaagcgcatcgtgtccgccgtcaacctgacgccagaaaatggactgctgcgaggtattcagttgggcataaagcgcctgatttgcctgaaacacgatcggctcacgcacgccggcttccagtacgatacgcagtccgcgcgcgcacaatgcgccggttttcagccgggtaatgacttccccctccggcggggtgatgcgatggggccaccagaacgatcctgactggcttagtacacagccaaaacgcgtcggccagttcaggccggcatacagcgccgacaggccaccaaagctctgtccggcgaccaccgttcgtccggcatcatcgctaaaaggcgtcacggctctgacttgcggcaacagttcctgctgcaccgccagccagaagtcggcattgcagggcaactcctggttgcggtgttgagtatcaatcgcgtcaatcagcagatagacggcaccgggaagcaggcgttgatgagtcagcgaggcgagcgcgggccagacgggcatattttccgcccagaattgaccgtccagcagaatagccaacggtctttcctccgtcgcctcgtctccggtcgtcaatatccatacgcggcgggagttacccagacgttcgctatgccactgcatcatcaaaggcggtgagtacgacgtttcaggacgatcccatcccggctgacggggcgcatccggcatttccagcgctgaaaccgcatgaccacgtcctccccgccagctttgcgaattaagcgggtcggcaatcgcctgcggtaatagctgtcgccagccttcacgcagcgcgttccgatcgggcgtttcgcccggcgcaaaagcggcaaaaacgtcatctcgctcggtaggaataaaacagtagctgccgcgccagttagcgctaagcgccgtgctccagcgccagacatccgttccggcaatacgcgccatcgtctgaggctgcgcgttttgatgatgatcggttacgccagtgatgtagacccagacacgccgtatcggggagtgtgtttcgtttccctgcgggtcgcgccaccaaaaagtgacccgataatttccgtctttttcccgtatccattccggcccggttttcgtcctccaccaggcctcacttcccgttgccagcgcctctttcattataaccctgtgtttattatgaattttgtatataaaaggtgaaatatattgataatattattgataactatttgcatttgcaatagcgtattgtagcgctatgggacgcgcgaacacaatttcaccacccggccaatgcctttgacgggcgctttggcttatgtggctaaagaaaagcaggatatacaatgaacaagaagattcattccctgaccttactggtcaatttagggatttacggggccgctctgcccgtgatggcggaagaaaaaaccgatagcgctgcgctcaccaatgaagacaccatcgtggtgaccgctgcccagcaaaacctacaggcgccaggcgtatccaccatcaccgccgatgagatccgcaaaaatccgcccgcgcgcgacgtgtcagaaatcatccgcaccatgccgggcgtaaacctgaccggcaactccaccagcggtcagcgcgggaataaccgccaaatcgatattcgcggcatggggccggaaaacacccttatcctgatagacggtaaacccgttaccagccgtaactcggtacgcctgggctggcgcggcgaacgcgatacccgcggcgataccgcgtgggtgccgccagagatgatcgaacgcattgaagtgctgcgtggccctgccgccgcacgttacggtaacggcgcggcgggtggcgtggtcaatatcattaccaaaaaaggcggtagcgagtggcacggttcctggaatacctatttcaacgcgccggaacataaagacgaaggcgcgaccaaacgcactaactttagcctgaacggcccgctgggcggggatttcagcttccgtctgtatggcaacctcgacaaaacgcaggcggatgcgcgtaatattaaccaggggcatcagtctgaacgtaccgggagttacgccgacacgttaccagccggacgcgagggggtcattaacaaagatatcaacggcgtggttcgttgggattttgctccgcttcagtctctggagctggaggccggttacagtcgccagggcaacctctatgccggcgatactcagaacaccaatacgaaccaactggtgaaagataattacggaaaagagacgaaccgcctctatcggcagaactactctctgacctggaacggcggctgggataatggcgtaaccaccagtaactgggtgcaatacgaacatacccgtaactcccggatgccggaaggcctggcaggcggcaccgaagggattttcgatcccaaagcatcgcaaaaatatgccgatgccgatttgaatgacgtcaccctacacagcgaagtgagccttcctttcgatctgctggtcaatcaaaacctgacgctgggtaccgaatgggcccaacagcgtatgaaagaccagctctccaactcgcaaacctttatggggggaaatatcccgggttacagcagtaccaatcgtagcccctattcaaaagcggaaattttctctctgtttgctgaaaacaacatggaactgaccgacagcaccatgctgacgccggggatacgtttcgatcatcacagtattgtgggggataactggagcccgtcgctgaacctgtcgcaaggtctgggggatgactttaccctgaaaatggggatcgcccgcgcttataaagccccgagtctgtaccagactaacccaaactatattttgtacagtaaaggtcagggttgctacgcgactggcgcgggtaccggcatcggctgctatatgatgggtaacgatgatctgaaagccgaaaccagcatcaataaagagatcggtctggaatttaaacgcgatggctggctggccggcgtcacctggttccgcaatgattaccgcaataagattgaagcgggtacggtgccgttgcagcgtatcaataacggcaaaacggatgtctatcagtgggagaacgtgccgaaagcggtcgttgaaggtctggaaggcacgttaaacgtaccggttagcgacaccgtcaactggacgaataacgttacgtatatgctgcagagtaaaaacaaagagaccggcgaacgcctgtcgattattccacagtacacgcttaactctaccctgagctggcaggtacgtcaggacgtttctctgcaatcgaccttcacctggtacggcaaacaagagccgaagaaatatgattatcagggtaaccccgttaccggaacagataagcaagcggtcagcccatacagtattgttggcctgagcgcgacctgggacgtgaccaaaaatgtcagcctgaccggtggcgtggataacctctttgacaaacgtctgtggcgtgaaggtaacgcgcaaaccgtcagggatacgcaaactggcgcttatatggcgggcgctggcgcgtacacctataacgaaccgggacgtacgtggtatatgagcattaatacccatttctgatggcaaccttccctccctcattcggggagggaattagcaaaagacgatgctgacatctcattttccccttccctttgccggacacaggctgcatatcgtcgactttgatgcgagcagctttcacgaacacgacctgctatggctgcctcatcacgatcggctccggtctgccggacgcaagcgtaaagctgaacatctggcaggccgcatcgctgccgttcatgcgctacgcgaggtgggcgtcagggcggtgcccggtattggcgacaagcgacagccgctatggccggacggcctatttggcagcatcagccactgtgcgtcaacggcgctggccgtcatatcccgacagcgtgtcggcgttgatatagaaaaaatcatgagtcagcacacggcgacagagctggcgccgtccattattgatagcgatgagcgccaaattctccaggcgagctcgctcccttttccgcttgccctgacgctggctttctccgccaaagagagcgtttataaagccttttcagaccgcgtcacgctcccgggattcgatagcgcaaaaattacctcgcttaacgccacgcacatctcgttacatctgctgccagcctttgccgccatgatggctgaacgtaccgtccgtacagaatggtttcaacgtggcaatagcgttattactctagtttctgcaataacgcgctttccccacgacaggagcgctcccgcttctatacttagcgcaataccccgataaatgagatcgctatggcgctgaatgattttcacgtttctgaaccttatacgctcggtattgagctggagatgcaggtgatcaatccacctagctacgatttaagtcaggactcttctacgctgatcgacgccgttaagccccaacttactgcgggagaaattaagcacgatatcaccgaaagtatgctggagatggccacgggcgtctgccgcgatattgaccaggtggcggcccaactttctgccatgcagcacgttattttacaggcggcgtcggaacaccatctcggcatttgcggcggcggtacgcacccttttcaaaaatggcagcgtcaggaggtctgtgataatgagcgctatcaacgcacgctggaaaatttcggctacttaattcaacaggcgacggttttcggtcagcatgtccacgtcggctgcgcgaacggcgacgatgcgatttatcttttacacgggctgtcgcattttgtgccgcactttattgcgctctccgccgcgtctccctatatgcaaggatctgacacccgttttgcctgcgcgcgcctgaatattttttccgcttttcccgataacgggcccatgccgtgggtcagtaactggcaagagtttgccggactatttcgtcgtctgtcttacaccacgatgatcgacagcatcaaagatttgcactgggatatccgccccagcccggcctttggcacggttgaggttcgggtgatggatacgccgctcactcttgatcatgccatcaatatggcaggattgattcaggcgaccgcgcactggctgctgaccgagcgtccctttaaaccgcaggaacaagactatctgttatataaattcaaccgttttcaggcttgccgctatggtctggagggcgtgctaaccgatgtctataccggcgaccgccgtcgcctggcagatgatacgctgcgtctgctggacaacgttaccccctctgcgcgtaagctgggcgccgacagcgccattgacgcgctacgtttgcaggtgaaaaaaggcggtaacgaagcgcaatatatgcgggagtttattgccgacggcggatcgctgataggcctggtacaaaaacattgtgaaatctgggcgggacaatagacagcatatttgccttaccaggcgatgtcccggacaatggcgttttaacttacgtttaacaaagccatgaaacacccgcttgaatcattgatgaccgctgccggtattttgctgatggcgttgctctccagcctgctgctgcccgccccttcgctcggccttgcgctggcgcaaaaactggtcgggatctttcatcttatggatctcaaccagctttatactttgttgttttgtttatggtttctgttgctcggcacgctggaatattatgttattcgctttatctggcggcgctggttttcgctggccgattaaacatttcaatgcgtacggccatgcttttctttacgataagcgcctggcggcaggttgaacgtgcgggtaaaaatgcgcgtaaaggtttgctgcgaatcaaaaccatacttgagacaaatatcatacaccttctggtcggtgtcgcgcaggtcgcgcgccgccagttttagcttccgttcacgcacgtagcgcctcagactctcccctttgtactgcataaaaaggcgctgcaggtgccacttggaataccccgcatgacgggcaatatcatcaatacgtaacggctgattcaaattatcatcaatccactcgacaatcgtgtcgataacctgagcggaaatggtcatcgtgctctcccctctatcaaactcgtcagcggctcccgcaccgcacatttacggcaacagcaataagcatagtaataaccacacaaattgtgagacggcttatcgcatggcctgcaatatgcttttctaccacttcatgcggcagcccttgattatgagtgagtaagcactcattatagaaagcaaagatacgccgtcaaggtacttttcaaaggttgacattcaccgttgcgacgcgacaacgggcatgattcaatcatgtttttacagacataagggtaacgtgtagtggctcgtccgaagagtgaagacaaaaaacaagcattactggaagcggcaacccaggcgatagcgcaatccggtatcgccgcctcaacggcggtgattgcgcgtaacgcaggtattgcagaaggaacattatttcgctatttcgcgaccaaagatgagctgattaacacgttgtatttgcatttaaagcagaacctctgccagtcaatgataatggagctggatcgatccattaccgatgccaaaacgatgacccgctttatctggaacagttatatcagttggggtctgaaccatcccgcgcgccatcgggcgatccgtcaactggccgtcagcgaaaagatcaccaaagagacggaacaacgggccgacgatatgttccccgaattgcgcgatttatgtcatcgttccgttttgatggtatttatgtcggatgagtaccgcgccttcggcgacggcctttttctggcgctggctgaaacaacaatggatttcgccgcgcgcgatcccgctcgcgctggcgaatatattgcgctgggattcgaagccatgtggcgcgcgctgactcgcgaggagcaataatggacggtcaaacactgcacgcctgtgcaaaacgctttgcgctggaactgccttttaccgaacactgctggcctttcggcccacagtacgatgtgtttaaagtcggcggcaaaatattcatgctgttcactgaacatcactgtcgcccagtggtgaacctgaagtcggccccccaaaaatccctggtgaatcaacaaatttaccccagcattgcgcctggctatcacatgaataagaaacactggatttcagtctatgcgggcgaggatatcaccgtctcgctactcaacgatttgataaatgactcatggaatctggtcgtagacgggctgcctaaaagagagcaactgcgcctgcgaccgcgctgatgcaataaccgtttccgcattttcctcccttatctttttaccgataacccggtaccctgctgatacaaaagggtactaaaccaaccaggagcatttatggatatcgtttctgtcgccttaaagcgctactccactaaggcgttcgatcccagcaaaaaactgaccgccgaagaagcggataaagtaaaaacactactacagtacagcccctccagcaccaattcccagccgtggcactttattgtcgccagtacggaagaaggcaaagcgcgtgtcgcaaaatccgctgccggaaactacacgttcaacgaacgcaaaatgctggacgcctcccatgtggtggtcttctgcgccaaaaccgcaatggatgacgcatggctgcaacgggtggtcgatcaggaagatgctgatggccgtttcgctacgccggaagctaaagcggcaaatgataaaggtcgccgctttttcgctgatatgcaccgcgtctcgctgaaagatgaccaccagtggatggcgaagcaggtttatctgaacgtcggcaactttctgctgggcgtcgccgcgatgggtctcgacgccgtccccattgaaggtttcgacgccgaggtgctcgacgctgaatttggtctgaaagaaaaaggctataccagtctggtcgtggtgccagtcggccatcatagcatcgaggatttcaacgccgggctgccaaaatcacgtctgccgcttgaaaccacactgacggaagtctaatcccctgcctaagccggacgcccgtccggcttttttcacctttctgccaggttccccaatgatcaatggcgcgaagtgccaggttttacatcgttagtgttaacttcctctttcaacctattgaaaataaatgatatttaaaactggcacgccgtttgccatatctggataccccctatctggatgaaggagaaaacgggtgagacatgtttatgtagccagccatggcccttttgcccgcggacttattaacagtctatcgctgctgattggcgacgaacacggcgtgacaccggtttgcgcctacgatggcgatattgtgtcaccacggggttggccctccctggcgtgtcatcaaaatcgggcgctaaacccaacgttataacgggtttgattgccatcgcttaaccctgccgtttgcgccagcccggcgaaagcggacactgttgccgacagcggaaaatctgcgccaatcgcgatatcaacccagtttttatcctgcgctttcccggcacggctaaacgtcagcgcggtcgatttaaggccgccgttcgccacatacgtatcatcgccaaactgacggcgataattaatctgcgcccaggaatgaatgatactgtggcgaagatccagacgccaacccacgctgcccatctgcgaatgggcgttttggtcgccaaaacgcattgatgtactggtattgagcttctcgctataaccattaacgtggctgtaatcccatgcatattgcagcatcggcccggtcgttaaccacggcatcatgacaaaatcataaccgctggttaacctcgcgccccacagccgaccgttggtttcgccctcttccacccgtcttagcgcaccgagcgtgatactgcgctgaatgttactgaatttagcggacaggtagtgtaaatcgccatccagccacgcctgaccggcgcgtaaatggctgaatacggcggcctgaaaaccgcgggcgtcataacgataattatcgtcaggatgttgcttatccagagaaccggctatcagccctcccagcagtacctgctcgttaagctgataatcgacgccaaccgtcagattattatgattaccgttcccgtcggcctcattattatcataacgttgatatcccccgctgtatccgccgaacatgcccagtgaaccaacaggattttccccctggcgaagctgctgataacggctgtcaagcgtggtacgactgccttgcgccatcgactgaacgctttggttcagatatgtcgcctgtaccggcgcggcaatgatcgactgaatatattgcgcaataatggtatggacctgcggaccgggatgtaaatgatcggcaaacagatagtcctgcgacgcattaaatccaggcattgccgaggagcacaccgaagcggatacgcccggcgggcaggccatgcctacggtatttgtcagaccaaacgcctgcgggttggcaagaatttccttaaagaggccgttgatatcggcacgggctatattgccgccgtgttgctccagccccttctcttccatctgattataataatcggtcagagctgacgcctgctctgccaccttttcatagcccgccagcagttgctcaacgagcagttgctgaataaacggattgctgcttaccgttgcagccgccgccagcaacgccttgcggatcgcctgttgccgactggcgaaatcgggcgtagctccctccgccagcgcctctaacgccgcttttagcgccgggggcgccgctgcgcccagcccggcggtgattaccgcctccagaagctctggcgtcgcactaatatccggtacgtttggcaccacgaccagcccggcgccggcatccagtaacagccctacctgcgccgccgcgctagtggcgctattaccggctatttgctgtgccatggcaggtcgcgcgatggccgccgccagatcgtttccgccgacccagtgaatatacaaaccgttgtggtcggcttttccccccgtattggcaagccactgccgtacctgatccgcggtattatcctgcgggtttaattccggggccgtcatcgcgccgccagcggcataattagaaccgccattgctggaagggcttaatgccagcccatatcgttcggccaactgttcgtcgtagagcttattttgaccactatcccaggtccagcgaccgttatttccggtatcgctaaggctatcgccaatcaccgtaagagagtcaaacgcacaggcagataatggcgcggccagcgccagcgagagtatgccgtattttagcagggtacgcttttgggtcatccgatgttccttaatgttattgttgataggtacgacggttctaatcattatccgacagagatattgcaatcgttttaaacattctggttaaaaagttttcattcattgttgacggactggcgcctgttcaaaaagagggaaccgcgtaaaataacgacgtttatagggcgctggataaaatatagcgtatggataaccccagaggcgcttttacccgtctgttgctgattatgcctgaagcgcaggcgtcctgatttgcataaatgccattcagcagtcatcataggctgctgtttataaaggagagattatgcaggaattgatatcccaggtagaagatttagcgggaattgaaatgaatcacaccacgtcgctggtggtgatatttggtattatttttctgacagcagttgtcgtgcatattattttgcactggatagtactgcgcgcttttgaaaaacgtgccagcgccagttcccgcctgtggctgcaaattattacccagaataaattattccatcgtctggcttttacgctacaaggcatcattgtcaatattcaagccgcgctctggctacaaaaaggcagtgaggctgcggatatcctgacgacctgcgcgcagttatggattatgacctacgccctgctgtcgttattttcgctgctggacgtgattttcaatctatcgcaaaaatggcccgccgcctctcagttaccgctaaaaggaatatttcagggcattaagctcatcggcgcaattatcgtcggcattctgatgatctcactgctgattggccagtcaccagcaattttaatcagcgggctgggcgcgatggccgcggtattaatgctggtctttaaagacccgattcttggcctggttgctggtatacagctttccgccaacgatatgctcaaactgggcgactggctggagatgccaaaatatggcgcagatggcgcggtcattgatattggcttaaccacggtaaaagtacgcaactgggataataccatcaccaccattcccacctggtcgctggtttccgactcgttcaaaaactggagcggcatgtctgcgtccggcggacgccggattaaacgcagcattaatattgacgcgaccagtatccattttctggatgatgatgaaaaacagcggctgttaaccgcgcaactgttaaagccgtaccttaccagccgtcatcaggaaatcgatgaatggaataaacaactggatgcgccggaatcagccttaaatcaccgccgaatgaccaatatcgggacatttcgcgcctatctgaacgaatatttacgccaccatccgcgcatccgtaaagacatgacgctgatggtacgccaactggcgcctgacgatcatggtttgccgatagagatctacgcctttaccaataccgtcgtgtggctggaatatgagagcattcaggccgatattttcgaccatatttttgccgtggtggaagagttcggcttgcgtattcatcagacgccgaccggcagcgatattcgcgcgctgtcagggacattgcgccattaatggattgcccgatcgcatgagcatgggatcgggcaaaaaagttaatgagccttacggcgcaaaacggtaaacgcgataaacagaaatacaatccataccggcagcaaaatcgccgacaatcgcatatcgtccatcgtacacattaacaccagaatcagcgccagaaacgcaatgcacaaatagtttccggcgggatagaacagcgccttaaattgcgtctcgcgccctttacgacgcatcgccgcgcgaaaacgtaaatgcgcgagacagatcattatccagtttagcaatagcgtcgcgacaaccagcgccatcaacaggctaaacgctttttgcggcaacagatagttgatcagcaccaccagcgaggtaatcgctccggacagcatcagcgagttcaccggcacgccgcgatggctgacgcgagttaaaaatttcggcgcgttgccttgtacggacaggccgaacagcattcggctattcgaataaacgccgctgttatacaccgaaagcgacgcgaccaggataacgaaattcagcgccgaagccaccacattactgtccaggttatggaagatcatcacaaaagggctgctattggatttcacctctacccatggatagagcgccagcaacaccaccagcgaaccgatgtagaacagcaaaatacggtataccacctgattcaccgctttcgggatgcttttttgcggatcgcgcgcttccgccgcagtaatgccgatcagctccagtccgccaaaagaaaacataatcaccgccagcgacagaagcaaaccatgccaaccggtagcgaagaaaccgttataacgccagaggttatcaatgctggcatgttcgccgccgtggccggagaacagcagccacagaccaaaacctatcatgccgataatcgccagcactttaatgagcgcgaaccagaattccgtttcgccatacagacgaacgttcaccagattcacggcattaatgataataaaaaacaccgccgcccatacccatgttggtacgtcaggcagccagtactgcatatagatgcccgccgcggtcagctccgccatcccgaccagcacaaacatgacccaatagttccagcccgacaaaaagcccgcaaacggcccccaatatttccaggcgaagtgggcaaacgatccggaaaccggctcttccacgaccatttcacccaactggcgcataatgagaaaagcgataatcccggcaacgccatagcccaacaaaacagccggccccgccatttgaatcgccgggccgatgcccagaaacagtccggtgccaatggcgccgcccagggcgattagctgaatatggcggttttgcaacccccgttgaagcgtcggttcattcttcgacgcggcatccgacacgctggcgccggatgcagttgacgcgtttttcacgtcctacccctgtatcgtttttattgaggggcaccttttaacatttcgctctcgctgccgcaaggcgcaatcgtttgtcaaggctcaactccggacgttaacgttatcgtgtaaaaaaagatgtcgcggggagtaaaaagaaaagagtacgcgccgatatagaacgttacgggtgacagacgccgggtataaaatatgtgaataactctggacgaaaagtacgacaccctacagaatacatttagtattttttcagtattttcaaaaaggtgaatcagacctggtatctgttatccatttttgagccacgccaggcgtcaacgtcatgaataagatcatcaaacgtttagagatcattaaaagcgccatcgaacttgaggacgaagagattatccgtcagcagctcatctacctgaaaaatgagccgcaggatgccgtaatcagcgcgattgcccaggcgattgaaactcgtcgattcagtgacgccatgcaagagatcgccgcctggctacaggctcaacgggcgctctcgacgtggcaagatccctctattgccgccagtaaactggagctgaaagcgcttgaagcccaacttcgcgatctgattgacaaacgaaatgcgcgggtacaaatcctcgacgatttcaacgacctctatcatctgcgtctcgggccgttgatgagccgtattctggagttgcgtaaacagctcgcggtgagtatgcagcgtaagcaagaggccgaaataaaacgccgggaaaaggattatcaatcctgcctgcaatttatttcccaggccgtggatcaactggcaacgctaaaacagcagtggacaggattgaatgccgcctcgcgcgaagcggtgggcatccgtcagcgaatccagcagcagacggaattaatcaccgcgttgctggcggaaattcgcgagctggaagcggatttttcccatcaggacgacagcgcattccgccaggcgcaggaaaatgcggaacagaactatcaccagtaccgggagcagcagcaggaagcgtaattccgctacgcccgcgatcaacgtttgtcggcagacgaacgcagtgaattaaaacgtttgtggcgtcaggccagccgcctgtgtcacccggatgtggtcgccgatgaattgaaagaaaaagcgcaccagatgatggtacagcttaatcaggcgcggcagaatgccgatctggcggcaattcgcgcgttattgacgcagctgcaaagcggtctggaaccgatgatggcaagcgacaggctaaataacctggaacatctgcgccataaaatacgccagctccgcacgcaaatcgacgcgctgttgaaagagataacgcagctggaaacggaaaatgcctggcggctcgcctcttccgttgcgaataaggaagcctatttctccgagcaggaacgggcgctaaccgaaattcgcaatacgctggaggcgcaggttcaacaggtggaacaggaacttctggcagggtagtccatcattcatcaacacattgtcggatggcgcaagcgccacccgacgaatcgcggcataaagagagtaagagggtcgctactggcgctgtaaaagtaacgaacgggcggagtccgccatgatcatcaccgcacctgccagcattaacgtatcttttaataccagccgcccggcgcccgataaatacgggaaaccataatgcgcatcgcccagcggcataacccaggcctccggcgtggtgattaaaaacgacagcgtgacaaatggcgtcaggaatgccagcacgccgcccgccagccctaaccagcggctaacagggttagccagtaccagcgccgcgataatcaattccaccacgcccagaccatccgaaaacgcatacgtattattggccgtttgccaggcgcgttcctccggttttagttcgccctcatgagtcagatgctgacgatattcttcaggatgttcatagaaaaaagacataaacgggctgttcgccacaaacggggtaatactgtctgcctcatagggcacaaattttagtagtccaatccagataaaaacgatggcgatactcaggcgaattaatgttaatcccagccgatccccctgacttaacagacgaagatatttatccatctcaggctctccttatttatataatatcgcagtggcgtaacccgtattatcaatacgcattgacgtaattttccatgacgacgcctgtttactttgcgccagtctggcaatagcgtcttcaagcattgacggtgttgctgacaccgcagaaacgctgatatattcaacgtcagttagcggctgggcggaggcggaaaacgccagcggcgcagccaataatgaagcaataagtgtggtaacttttaacatcgagatttccagtcgtgggttatttcaatggtgttataatacgttatgcctgactaaagccttttctttcagacgccagcatatttgtcctgtcgtatttttatggtctgacaggcaaaaaaaagccctgattaacagggctacattatttatgttttacttaatgagagagaagagatcgtttaaagactcactcattgtaggatgggtaaatatctggtcgcgtaacaccgtataaggtaaatctgcatccataacggttttaacgatattaatcatttcatgagaatcgacgcataacaatgacacccctacaatacgctgcgtattcacgtccactaccgcttttagtacgccacgggtatcattcataacacgggcgcgagggatcgccgccaccggtaatgtcaccacctgcaccgttgcgccgcttgcccgcgcttgttcttccgtcagcccgacacgagagagcggcggcgtcataaagacggaatacggtacgttctggcgatcgcgggtactgcgtttgccatctcccaataacccgtcgcgtacaatacgaaaatcatccagtgaaatataggtaaactgcaacccaccggtaacatcgcccatcgcccagatattgtccgccgtggtacgcaggtaatcatccacgatgatcccgccgcgttcgttcaccgccacaccggcgttctgcaactgtaagccagccgtcgccggttttcgccccgacgccaccagcagggcatccacaagatgcgcgccttccggcgtttcaacttgtaccgcgccctccgttgaggatacggcctgtacgttggcgtttaaaattagctcgacgcccttttcctgtaaaatgtgggtaattgcctgcgcgatatcccgatcttcacgaggcaagaattgcggcgctgcttcaaagatagtgaccttcgtaccgaagttagcgaacattgaggcaaattcaaggccaatataaccgccgcctaaaatccccagccgcgccggacgctggctcaggcttagtagcccggtgctatcgaacacccctgccgtcgttgttaagcccgtaatagccgggatcaccgactctgcgccagtattaatgaagatcttttctccccgtaacacccgctcgccgtccgcctgaaatacccgtaaggtatggttatcaataaactccgcccttccctcaatcacatcgacattgtccaggtcggcaagattatgaaaatttttgtcgcgtaaaaaatttacgaccgccgctttgcgttgcatggcgacagaaaaatcgccctcacgttccgcgtcatacaccagcgttttcgttggaatacagccaatgttgatacaggttccgccaaacatactggcggactgttcgataatcgccacgcgccatcccgtcttcgccagagttgccgccaacgtttttcctgccttgccaaaaccaataatgagcgcctgatactgtgtcatcttctttctccgccaaatcaccatctgtttgtcaggacaagtataaataacgtcaaaaaagacagggttatccgtaacgcgtcattttttgtcttatcgtctaaattagcggttaggaaaaacaaggatagaaatgacattgagtccgaaatatagtgatcagagacagaaatggttatccttatttttgaaaataaatctgttctggagtctatatggatgcgcttagtcggctattgacgcttaacgcccctcagggctcaatcgacaagaattgcccgttaggcggcgactggcagttgccgcacgccgctggcgagctatcggtgattcgctggcataccgttacgcagggcgaagcgcaactggaaatgcctaccggcgacgccatgacgcttacgccgggaaaggtggtgattctgccgcaaaactccgcccaccgtttgcgccagtctggcgaagcaccgacacatatcgtgtgcggtagtctacgtctgcacacgacgtcacgttatttccttaccgcgttgccggaagtgttatgtcttgccccgccgccgcatagccccgccagtatctggcttaacgccgccatttcgctgttacagcaggagtcagaacgccatttacctggcgctgatgtcttatacagtcagcagtgcgccacgttgtttaccctcgccattcgcgactggctatcgcaggctggcacggcgaaaagcgtgctcaatttattgctgcatccccggctgggccgcgtgatcctgcacatgctggaaacaccggcgcatccctggacggtcgaaacgctggtgcaacgggtacacatgtcgcgggcgagcttcgcccagctatttcgcgacgtgtccgctacaacgcccttagccgtgttaacaacgctgcgcctgcaaatcgccgcccagaccctgtcgcgtgaagcgctgccggtgatggtgattgccgagtcggtaggttatgcgagcgaatcttcttttcacaaagcgtttgtccgtgaattcggttgtacaccaggcgagtaccgcaaacgggtcaacgcgcttggacgataaacgtatactgaacccgcctacagtttgacgccgcaggcgggcgacacacattatgccgcaaggcgacgatgcctgcgcagccacatcagcttgtaggctgccggaatgatgaacagcgacagcagcggcgcggtaatcatgccgccaatcatcggcgtggcaatacggctcatcacctcagaacccgcgccttttcgatcgtttttatcgcgttgctccctcccgccagcgtaaaggggaaggccgcggtataggcctggcaattgtaaaatccatcgtcattgcgcatcagggaaaagtttctgtcacctccgatacgcgctactcgttttattttgacattacccaaacacctccgttgaactgtagcgatagtgaaaggcgctatcactagccagcaaaataatctgatataatcgtcattatcccgtcacgcgccaaacccaacaactgttttattatttctcttattaacccacaccggagaaataagataaataagtttacatcccttttagctgtcgtttttatttcagctggcgtacacaccgcagagaaaatggaatcccgccaattatccgctacagcacatgagatgatgaataacggtgacgccttcgcgcatcagcaaatggctcagacacagaaacccagcgccccgactactgtggaaaatgcgacacccttttctgaaatggacgactatgaaaaagcaatggtcatccatcaatcgatgaataatgcccattctttctcccacgagatccaggctgaagagcaccataaacagattaaacgcaattagttatttgcatattagcgtcacgtactgcggatggcacaacgtcgcccccgcagaagcttacggattaacataattttgagaggttaaatggcgcgccctgcaggattcgaacctgcgacccacggcttagatgttcctggaactacctgagctaacaacaagttatcccattaccacggcgctcactcgccccatcttcgaaaaacatgcaaagctttgtgtgtcccgtttttgtcccaacccactcagcaatcagcagctccaattgatcggtaacaacgatcaattaataagacaacaataagttcaagctatcaaatataacattattgatcgtttatatcgaaaaaagcaatttgtagtactatactccagacctttccgaatccgctgattttcataatgttgaagttattcgctaagtacacatcgatcggtgttcttaacacgcttattcattggggcgtatttgctttttgtgtgtatgggatgcatacgcatcaggcgctggcgaacttttccggttttgttatcgccgtatcgttcagcttctatgccaatgcgcgcttcacctttaacgccagcaccaccacgcttcgctacatgatgtacgtgggatttatgggaacactgagcgccgttgttggctggatggctgacaaatgttccctgccgccactccttactcttgtcaccttttcagctatcagcctgatatgcggattcatttattcaaagttcattgtctttagggatgcgaaatgaaaatctcattagtcgttccggtcttcaatgaagaagccacgatacctattttctataaaacggttcgcgagtttgaagagttaaaaccgtatgaagttgagattgttttcatcaacgacggaagcaaagatgcgactgaatcaataattaacaaaatagctgcatctgatccgctcgttattccgctttcgtttacgcgaaacttcggtaaagaacctgctcttttcgcgggtctcgaccatgcaaccggggatgcggtcattcctattgatgtcgatttacaggatccgatagaagttatcccccatctcattgagaagtggcaggctggcgcggatatggtgctggctaagcgctcagaccgctcaactgacgggcgcatgaagcgtaagacagctgaatggttttataagctgcataataaaatcagcaatccgaaaattgaagagaacgtcggtgatttccggttaatgagccgtgatgttgtcgaaaatattaaacagatgccagaacgtaatctgtttatgaaaggcgttctgtcatgggtgggcggcaagactgatgtagttggatacgcccgcgctgagcgtgttgccggcgattcaaaattcaatggctggaaattatggaatctggcgctggaaggaataacttctttctcaacatttccgctccgcatatggacgtacattggattgtttattgcaggtatgtcgttcctttacggtacatggatgattatagataaattaatatttggaaataatgttcctggctacccgtctcttcttgtttctgtacttttcctgggtggcgttcaattgataggaataggtattcttggggaatatattggcaggatttacatagaaactaaaaaaaggcctaaatacataattaagaatgggaagaaaaatggttaacaatagattaaaaatggtaattgctatccttatagttttctcattggtgtattcaataggatttattacaccaatgaactctgatgactatacttatgccctaagagagctttcgctttctagcgtaaaaatgcactatttgggatggagcggaagggttgtgtcagatacgctcagcacatctctattaaagtttttctccccgcatatttacaatgcaataaactcagcagcgctaacattaatggtgttgtgctggacaatgatcccagcgacattaacaaagtcgtcaccgtccccatatgtgatgattttcttatttttcttatacttcattgcaaatccagctctcggtcaaactaacttctggcttgttgggctagcaaattacttatggaccaacatgttcattgccatttatatactaatttctatatatttaagcaatgccaaaaaatccaatttaatactctttgtatatgccatatcatcgatatttgcaggttgctcaaatgaaaatacatctcttgtagttgtattaatttctgtagcatatttttttataatgaatagaaataaatatctactgattggcgtattcggatctgcaataggcgcaggggttctcctgctggctccgggaaacctatcccgtgcgtctacaatacaagactggtacaaccaaccacttgcatggagggttcttgagcacttttcagaaaggctgccatcagcaatgggggcatattggcaggtctatattgcatttataatactactaatctctgtagtgttatcaaggaatagtagcagcaaacttatgtttggaagctttttattcatactgggtgcaattgctgcaaatgttgcgttccttgcatctcctgcaatgcccagcagggctctcaatggagcactctgctttatgattctttcgatttcctttgttgctcattctgcatttacgaaatttaacaaagcttccatttatttatctattactacatatgcaatggcttttttatatttcattccatcatacattctctattactcatcaattaaatcaataagcaaacaaacggagattagggaagaaataatagacagggcgaaagataacaaacaagatcaagcgataattcctgattattactttccaccggtactgcatgcaggcccaagtcttgatacgtttaacagtgaagcaatgtctagatactacgggattgatgtaaaaataactgctccaggatttttcgactattcgcgagcctttaatctcaaacctcttaatattaacgcaaaaatatgtaacaacgtttatataaaatcattatggatatataaacagcaaatgggcattaaaacctttgtaatatttgagtttaataagaatcctgctgattctcttgatgagaatacagcgatgttcattagcttaaaaacaaaggatggaaaagttataaatgcagatgtcgacaagaagacatttcaaatagacggaagatggctttcaggacgggcgattaacggcatagattcaaatgaattagaatcaattacatctgggacatgggacgttagaacaggggcgaggacaaatgagaatattacggaaataattaaataacattcatgtataattaatgttccccgccaccaatgggtaacgggcggcggggattcctacatatcgtatgtcacaaatgccccatcaggtttcttagcaagaagtcgcaatgcgccatcagtcccaaaaaagaacccaacggagccatagtgcattaatccagactccggcaactgaccaatacacgcaggatacgcatgtgcccaaagcccatccggttcaactccaccacagatgcaggaacaccgtcttttagtgcggataaactgacccctactggtttcactaccgggtaaaggaatctgataatctgcggtcaatgtgaatcaccacaggtttaacagacacctcagatccatttaagatgacttaaagagaggtgcctatgagcggtaaacgttatcccgaagagtttaaaattgaagcggtaagacaggttgttgagcgcggccattctgtttccagcgtcgcaacacatctcgatattactacccacagtctttacgccaggataaagaagtacgggtcgaactcctccaccaataaagaaataaagagcagtcagatgatcagaccggaatccgccgactcccgaaagagttgaagcgggttactgacgaacgggacatattaaaaaaagccgcagtagactcaattggtcactgcaaccatgaatgacaaaagatggagtcctgaatgcgctcctgatggccgtgtggcgacataatcacccgctatgaatggcagtcgatcctgaaatcgcacggactggagggcagtatgagccgtcgtggcaactgtcatgaaaatgcggttgcagaaagctttttccagctactgaagcgtgaacggataaagaaaaagatctacggaacgagagacgaagccagaagcgatatttttaattacatagaaatgttttataacagtagacgtcggcatggttcgagcgagcagatgccaccggctgaatatgaaaacctatatcatcaacgactcagaagtgtccaggttatccgtggcgattcacagatatgctcaccttgcgcctaatcatttaacggaacacgcgaggaaaatagacgacatttttggtgatgatgtcccaaatatgtcccatatggaaaataaggaggaaataaagaagcgtaacgcgttgatttataagtggcgcgccctgcaggattcgaacctgcgacccacggcttagaaggccgttgctctatccaactgagctaagggcgccttgtgaagtgaagacttcatgtagacgaaacgcgagaattatacggtcaggcactcctgagtcaatggcttttgttctggttgctgactaagtgtacgaatatcgtcttttctggcgcaatgccaggttccaggaaatcgcctggacacatctcagcacgcataaagtgggaattaaagccgccagtatttagataatcaatcagtttctttaatatttcaccatgactcacctgccgtgtaggatattttttatgctgagtatcgctattaaggaacaaaacagtcactttgagcatggtttgaaaatcatcatgacgcgtctggcgaatcaatggcagcagaaaattgactttctgccgccagaagagatagataatgccgatatcgctttcctgaccctggatgatgattggttcagcgcaggctgttaccagatacctatgcatactcaacatcagctacgggtaattatttgtaataaatgcgataaagaaaagctcatgttcagaccatgtctgtatatgctgccgcatatttatcgggaagatgatgttgaagaaattacccggaaaatgatattgatcttacataagcgagcgcttcgacatagcgtcccttctggcatctgccactactgcacgactcgccatttttcagtaacagaacgtcacttattaaaactgatcgccagcggttatcatttaagcgaaacggccgctttactttcactttctgaagagcagacaaagtcactccgccggagcattatgcgaaaattacatgttaaaacggagcagcagtttttaaaatatattagagttaaccttcatttcttactcagtaagtaaactcacttaactttttacaaagcttacgaaatatctcaccaataattaagtaacgatacctacaggcatttttttaacgctgccacaatgatacccataatatcctgatagattcaggggtcaaaaatatatggctgcatcataaatgcctgaaggagtgtttggtggcacagggtactttattaaaggaaaggataaatcccccacacctggcgtcttcgccaacacgccattcatatctcaacagcggattgttaaaatctgagccaatcgttcatctctcaactgcgcaattaatcggctatgaggtcctgacgcaacttccgtcagaacatgatagcgaagttttttttcagcagttaatgctgatggaaggcattgaaacatcagagcaacgaggcattgctttttacgctggtgcaacgatgggacaaggttatttatggccagccatattaccagatatatattagagcaatggaaaaagcaggatgcgcagcgtaccatgcagggaaagacaccgccgtttaagaaatgccaaagactgcgcctgccgttatcactctccaacgccgcagatatttgatcgccttgagttactgaaccaacagctaaattatgccttgccggttggtatcatttctcaggcaataattacaactgataactacctcggctattcattgagtcactacttattttccggaaaacgtaccgcagcattccgctcattagatgacatttctttgtggattgaaaaggggtcgctcagacaactgattgtagatatggagacgctacctgtctcctgtattgaggcgcttaaccagctacacgcgctcagttggcaacaaagcgatatccagatttacctgctggtatcagataaaacccccgctatagctcagtttatccgtatggctgggcgtttttttgtcctgtcgcgacgacaaaatctggcctctgtacgcgaagccttgttatcagccgccgaacctcgcttatcggaaagctttagccgtactgactggttgatgattgaaactttagcgcaaggtgcctctttaaaagaaatagcacgtcagcaaagcgtaccttatcatcgtgtggtttaccggcttaaacaacttatcaccctccttaaccttccccacaggcaaagctttcttcggctgatccagcagctaaacgttactttccacgacattttttaacgaagtaacgttttggtgaataagattttttaagaaattacttattttcactgccattaaatgtaaatatttcacataaaattaatatttacaactcgtcctggtaagcgacaaaaaattttttcttacatcgtcccctgttcctccttgttttttgcggtctccagcgtcaacatctttctgttattacataacaaatactaaacaattagtctttcatattatttttatacttaaaaacaacagtttaaactacttaatgtcaactctaaagaaaatagctccaccacgaacaaattttctataacgtcacagaacatcctacccgctatccataattcgcatttcgcaagacttttccgagaaatcagaccaggtataatccatattgtttttacttaatcagaaatttcttttttgttggtgcgaaatggatattccacatatttattactcttacgcaaaatagccagtcaacagggaggtctcattctttattattgctccaccgtgtggtgtgtagatctggctatttcacaatctttaaggtgtctgacgcttattctaaaacgaaggacgcataacagtctgaggcatacaacaatgaaacctgcatctgttatcattatggacgaacaccctattgtaagaatgtcgatcgaagttttactcggtaaaaatagcaatattcaggttgtcctgaaaacggatgatagccgaacagcgatagagtatctgcgcacttatcctgttgatcttgtcattctggatattgaattaccgggcaccgacggctttaccttacttaaacgaatcaaatctatccaggaacatacccggatactttttttatcgtcgaaatcagaggctttttatgccggaagagcaataagagcgggcgcaaacggatttgtaagtaaacgcaaagacctcaatgatatttataatgcggtaaaaataattttatccggctattctttttttccatctgagacgcttaactttatcagtaatacccgtccccccaaaggcgggcaccatgatatgccactttctaaccgcgaagttaccgtgctgcgctatctggccaatggaatgtctaacaaagaaattgccgagcaacttttattgagtaacaagactatcagcgcgcataaggccaatatattttctaaacttggccttcactctatcgttgagcttatcgattacgccaaatcacacgaattattgtaaatgtactcccggcgaattatcgttcgggagccaaaataacggacactaattgtaattgatcaggaaggtcgcatccgcgttagcaagaccgggctgcacgccatcggctaaggcgatatagttcgcatagaatttcagggtagcattgccgttgttgtcaatatcgacggccttgctggcctgttcaagtggcaatcgacgttgatcgccatcgcgaatttcaatcgccagtttttgcgccattgccgtatcagcaagcgccagtaatgccgtgccgggcgctggcgtcccggaaaacgttatagacgccgaacctggcgggcagccttcaagttttaggctaaaggctaccggttgcgtagcgtccccggcgacgtgaagctgttttgtcggccaggtgccgaggttaaccgacttgttactgtcgcccgcaaccacggcgcaggtaaaatccaccacgttaccgcgcagttcaatattcacttcgcccagagatgagttggcctgactcagcgggcttaacaaaacacaaccgatagcgatgaaaacgcgccgaagaatcattatgcctccttaatcataatcgactcgtagatagccgcgcgcagtaaacggcccttccgccggtttattccccgtcacgctgatcggccaggcgcgaatacctacgcgagcggcggcgttatcatcaagatgaaacggaattttactcgacaaattattgggtgtgagcggcgtaccgttgctattagcaaccacaaagcctaaatccgggttatcggacaccatcgcctgccctgaggccttttcggcttcaagccgcatcgataaataggcttgcgccgcgacgttggtacatttgatagcgatagttttcgcttgcggcgtgacgccttgcggacgattacccgctcccgcctgactaaataacggcgcgccgatatcgccgaaatcaaactccacgacctgtccggcattcacttcacagttttgcggtacttccactttgccgctgtagctaatggtatacaccggcgtgctcaacgcgtcgccggtagaggtcgtcacatagacggtaaacattgtctggcgggggatcgtcactatattaataaaaggccgtatcacttttaatttaaaaaccagctttgagtcctgcacgccaaacggcttttgctgcgacacgttagagtcgacgcccatgcgaatatagttacggggcggataaaatacgccagcgacactatcggttatgctcatcgcgcccagaaggtagtcattcaacttgaggtatttaaaatttccttcggtgctttgtaccggtaattctgatacatagcttcggtaggtataattcaccgttgtccccgccgggcacgtcgcgtttacgccgcaccaatctgattttttcagcagcgtcaccacctgtcccggctgattattgccgctggtgaaaacatctgacaggtcataaaagatatcggtcgccgtcccgtttgaattacggcaaaccgtcgccagcgcgggatgggtgaaaaagagtgcggtccccgccagcaatagcgctgagtatattttcatctctatttttccttttatgacgacggacggatacaggtcgcgctggctatcgtaatcgcctgcttcaggctatcctccgccagggcgtaaggggcgatacaacgcgcgtttttcccctctccccactggatgaacagttcaccttttagcggcaagccgctcagataaatttgtccgtcatcgccgaccatgctggtaatgccgctggcggtttctcgtactatcgcgccaaacggtaacggacgtccgccaagcctcgcggtaatgattgcccttacgcctatccgcgtatcaaaagcagcccgcaccagcgcgccttcagtcggcaccacgctgctgacgttattttcgacatcggtatggttgtccatcgtgttggtatctaacgcgacgcggttatagcgatataccgtggcgtagggcattaccgcatagccccgccagtccgttttcacgccggtctggttttcgatgcgcacgcctttcgctcccggcgctttaatcaagacattggtatcgcccaacggttggctaaacgtaataccatccgtatgaccgaccacgccgccggaaagttgccagttatagtcatgctgatcgcgatcgtagttatatcccacgcccagcgtgccatacgtcgcctgccagctagcgctggcgctgccgctatgaccattggtactgctacgcccctgcgtcacgctgtagctcagattacgtccttccagaagcgtgccgcccacaccggtctgccagctattgtcgccgtcgcggttgcggttggcgttaaacgtggcataagtacgatcaagaatagtgtcgcgcgcatagcgccgtccggtcagaacgctaaacggaacggacatattgaatgccagaatgcggtcggcgcctgagatccccaccgactcgctccacgaccatgacagcgaataacttatgccttgccatccactggcgtatcccagttgataccaggtattggtatccgccgtattccagtaattttgttgactgccggaaagatacagtgacccgtaattccccagattttgcgaaatattgacctgaaagcggccttttttgctgtagcggagattgtggtagctctgcgccaccggcactttatggcggcgtccgtcgctatcgtattcgtagtcgtacccttccatactgcggtatgccacatcatccagggtgtaaaatccgcgcgtggaatagcggtaacccagcaattgaaaattagtcccgtaattattcagcgatttggcgtacagaaaacgcaacgattgcccctgatgggtgctgtcatctgccagttggctacgcgcatgtgtgacatcgaccgacacggccccccagtcacccaaattttgccccgccccgaccaccacagcacggtaacgatcggcaagttgcgtaccgccgtaagccgtcagccccgcaggcaggccggcaatcaccgttccctggaaaaagaatagcgaagactgctgactattgccgctgcgaaaatccccggccaccaggtcatacttcaccctgccctcacgctgcaatagcggaacggtagagtaaggcaccgtgtaacgttgttggctaccgtctttttcatctaccgtcacctcaaggtcgccgctggaagaggtaggattaagatcggtaatcgcaaacgcgcccggcggcacatagctttggtagataacatacccgttctgtcgtatcgtcagctttgccgccgtccgggcgatccctctgaccgtgggggcgtagccctgcaggctatcgggatacatattgtcagaagagtacagccgcgctccgcgaaagccgacgctgtcgaaaacatcgttcccggtatggctgtcccccatgaccagttcgctttttagcggaatgatggcgcgctgtacccaggtgccaatgttgttccagcgttgcgaatgatagccgtcccctttcgaatagctccaggctccgttattacgcagccgccaggggccatagttcaacccgctcagcagactcaaaaaatagctatcgctgtctgttccgcggctaccggtaaaactgtaattaatgagtgcggcgggtatcccttcatcccactcttccggcgggatatagccacgcgcgctgttgagcaatgacgcctgcggcaagctaatgtttaagcgcatcgacgcgaaatcgaacgcgacctccgcgcccgggattttctcaggaaggtgaatacacgtggtatcgacgcctttatctgagacagggaacaccgcggtattcacgcccagccgtttaatcctctccggtgtaaaacaaggcatcaggccgccggatttatcgccggcgcccacggcgcccgcctcaaaacgaatatcctgcgtcgctacgaattcgtcgttacgccagatatccacccggtaaataccgggaggctgatgattacctttttcaaagcgagataaatccgccacggacgcggtatccgccgacaaaaacgcagggttgaaataactttcgccgcggctcgtcagcggacacagagctgccaacaccgacagcgccacgccgcttaacggtgatacatagccgggaaatcgccctgcaaaccaggttgtcttcttcatcgtgttctcgtgtggcttcacgctctctgcttaaccgagactggctgttgtcgccgacgtcaatgcgccgtaatcattgacggtctgaaatgtcacgctgccctgcgcgccagtcggtaagggaatttgcatgtcgctttttggcgcgatcatcacgttatcaatctttttcgcacccacgctgatattgaccagcgtgaggtaataagcagatgggttggttatcttgagatggttgccgacacgggaaaatttcagcaaggtcggcgcgtcttccggcgtctgcggcaaattcgccggacgcacgaacagtttgatgcgcgacagaatcgccagttgcagaacgttttttccttcaatatgacttttatcgaccgacgggatggctttcacgttcatccagaataacgactcccgatcctcgggtagcggttgcccggcgtagataatacgcagcgtgttttcacttttgggctcgctgacgaataaaggcggcgtaacgataaacgttttttctttctgcccagcgttattttcgatccatgaattgacgaggtaacgttcttgagtatcgctattactgattgccagagaagtctgtttcgccgccgagggataaataacacgcgtggcgcctaatgcaatcccccccgccgcctgtacgttcagcgaagtaaataacgtgagaagaacaataaatcctaattttatactattcagcatggtaaaaaataccttttgcattgagtcacgtcggcaagaaaattcatgggtaaaccagcgtaaaccacacttctgaatgaattcgtcccggcgtcatattttctgaaattgcccgatagcgggcggtaaaatgcaaagtcatttctgacgttaaaatgggcgcgtaatgaagcggtaacgtgttaggtatgatttgccgctgctggtcatcaaataacgccaggccgattccggcattaccgataccttcgccgctggccagaaaaacatggggatcttccgcaggcgtaacgccggcaaacgcaatgccgacatgacgccagacctccgcgctacaggagattaaccgtaacgaaaatggaacgctgacgggagcgaagctgccaggaccggtaaacgcattcgtgcggtactgtcccatcagtacgcgcaaatcctggctttcagtggcgacagcgcagccgccattgaccagttgtccgcgcaggtgaacacgcccgctctctaccattaccggctgcgcaatgacgggcgacatcaaaacaagccccactagcgccgcgcctttccttatcatctgctatgttctcttttatccccgatagcctcttccgttgagacgcctcccttccctggcgttccctgacgggattattcgtatttcatgataaaggtggcgtcggcattagcctggcctggcgtcgcggcggcggttgccttatagcgtgcggtaaaacgcagcgtattggtgccttcaaccagcgcctgcttcgccgagaaggtcgcgccgtccggcttcaacggtgaggaggtgttatcaagaatctcaatcccgacgccggttgcggtagtgctattgtccgcagaggagaccgccagcaaattagtgttggtgttatctgcctgaccagagaaagccacggcagcggtggccgccacttttggatcgcagtcattcaggacgatggagaaaggcacctgcgcggtcgtatcaccaatcgccgtaaagctggcggtacggtattgacccagcgtcaccgtttgatcggcggatttagtgctaacggcacaggctgcataaaccagtttaccttcgaaatgaatagtaccgccgctcacgctcaccggagtaggatcagccgcaaccgctgcgccagcgacaaacatcagactcgcaatagtagaggtcattaatttatgtttcatggattttccttgaattacacacacccggtttcgatatcctgtcggctccgtttgaattattatcgacatagcatgtcagaaaagttatctctgcatcctgtaaagatagatatcgcagattaattagttttctgtttctcccctgagtatcagacgcagtaattaatctttgcgaatatgacatttcgtcacggtaataaattaaacatttcgctaaataaaaaatagccgcaaactcttttaatgacctaagctaattcttatttggatataagaagggtctaatcttattttgtataaaatgtcgcattatgccgcccgatgctattaacggcgagggattacggtaaccatagccagggtgatgaattgtttctttttggttaatcatggcgcgcttactggtcacgtctcagtatcgtcaacggacgggggagacgtcgcgtttgcatcggaaacacaaacgttaactgacagcgaggcccgcttctgacaaaatagcgttatcccctttgacttgaagtaacagatggaatcttctctctgatggcagcaaagattattgacggtaaaacgattgcgcagcaggtgcgatctgaggttgctcaaaaagttcaggcacgcgtcgcagcgggtcttcgcgctcccggcctggctgtggtgttggtcggcagcaatccggcctcacagatttatgtcgcaagcaaacgtaaagcgtgcgacgaagtgggattcgtctcccactcctatgacctgccagaaaccaccagcgaagccgaactgctggcgcttatcgatactctgaatgcagataacacgatcgatggtattctggtgcagttgcctttaccggcaggtatcgacaacgttaaagtgctggagcgtatcgcgccggataaagacgtagacggttttcatccttataacgtcggtcgtctgtgccagcgtgcgccgcgcctgcgtccctgtacgccccgcggtattgtgaccctgcttgagcgctacaatattgatacctacggcctgaatgcggtggtcattggcgcgtctaatatcgttggacgcccgatgagcatggagctgctgctggctggctgtacgactaccgttacgcaccgctttaccaaagatctgcgtcatcatgtcgagcatgctgatttgctcattgtcgccgttggtaaaccgggctttattcccggcgaatggattaaagaaggcgcaattgtgattgatgtcggtattaaccgtctggaaaatggcaaggtcgttggcgacgtcgtgtttgacgaagccgcggcgcgcgcgtcatacatcacgccagtaccgggcggcgtcggcccgatgacggtcgccacgcttatcgaaaacacgctgcaggcgtgcattgaatatcacgatccacaaggaaaataacatggcgacattctctttaggcaagcacccgcacgtcgagctgtgcgatctgctcaagctggaaggctggagcgaaagcggcgcgcaggcgaaaatcgccattgccgacgggttggtgaaggttgatggcgcggttgaaacgcgtaaacgctgcaaaattgtcgccgggcaaaccgttagcttcgaaggccaaagtgtgaacgtcgtggcctgattacgctgtcttttcagataatcatccacttaatcctctacgttccaactgctagcatggctatttccctgtgaacgatcgctatgcctaccgttatcacccacgccgccgttcctctgtgtcttggcgcaggcttaggcctgaaagttatccctcctcgcctgctgtttgccggtgttgtgctggcgatgctccccgatgctgacgtgctggcctttaaatttggcgtcgcctacggcaacgtgttcggccatcgcggatttacccactctttacttttcgcattcgtcctccccctgttgtgcgtactcgcgggacgacgatggtttcgagcggggcaggtgcgctgctggctgtttttaaccgtttcattgttgtcgcacagcctgctggattcgataaccacgggtggtaaaggcgtcggatggctgtggccgtggtcggatgaacgtttctttgcaccctggcaggtaattaaagtcgcgccgtttgcgctttcaagctacatcacgccgtatgggcatcaggtgattgtttcggagctgctatgggtgtggctaccggggggcgtgctaatagggatattgggctggcacagatggcgtataggggacgaaaagcggactcgctaatgtcggacggcgctacgcttacccgacctgtagatttcatctcaggtaggccggataagacgccctgcgtcttatccggcaatacggcaattacttacgtcgccaggtggtgccctgcgggccatcttccagaataatacccatttcagtgagacgatcgcgcgccgcgtccgccgccgcccagtctttcgctttacgggcatccagacgctgttgaatcaaggcttcaatttccgcaacttcaccgtcatccgcctgcgcgccgctttgcaggaaaacatccggctcctgctccagcagtcccagcacgccggaaatcttccgcagatgagacgccatcgcattcgcggcggtcatatcttcgcccttcagacggttgacttcacgcgccatgtcaaacaggacggagtaggcttccggcgtattgaaatcgtcattcatcgcctccacgaaacgcgcttcaaacgcttcgccgcccgccggggccgctgatttatccgttccacgcaatgcagtgtataaccgctccagcgaggcgcgcgcctgcttgaggttctcttcgctgtagttcagttggctacggtaatgcccggacatcaggaagtagcgcacggtttccgcatcgtagtatttcagcacgtcgcgcacggtaaagaagttgcccagcgatttggacatcttctcgcgatccaccatcaccataccggagtgcatccagtagttgacgtattcgccgtcatgcgcgcaggtagactgggcaatctcgttttcatggtgcgggaacatcagatcggaaccgccgccgtgaatatcaaaatggttgcccaactgcttacagttcatcgccgaacattcaatgtgccagcccggacgcccttcgccccacggcgacggccagctcggctcgccctctttcgacattttccacagcacgaagtccatcgggttacgcttcacgtcaacgacatccacgcgcgcgcccgcctgaagctgctcaagatcctgacgggaaagctgcccataagtcggatcggtcggtacatcaaacatcacatcgccgttatccgccacataggcgtgccctttctcgattaaggtgcgggtgagctcgataatttcctgaatatggtgcgtcgcacgcggctcgctgtccggacgcagaatattcagcgcgtcgaagtcctgatgcatttccgcaatcattctgtcgaccagcgcgacaaaactttcgccgttttcattggcgcgtttaataattttatcgtcgatatcggtaatgttacgcacatacttcagcttataaccgagaaaacgcaaatagcgcgcgacaacgtcaaaagcgacaaacgtgcgtccgtggccaatgtggcagagatcgtaaacggtgataccacacacgtacatgccgacttccccggcatgaatgggtttgaattcctctttttggcgcgtcagtgtattaaaaatttttaacatcgaagattccgtatagacgtgtgtgggtaattaggtgtgtataatactcataattcaaccttgaagcagcacactttgcaaggtgatcgcagcttacgattatgctataacaagcccctatatgtgccccattgcgggctaaagcaccactctcttggaacaggatgcaaaaatggttactttccacactaatcacggcgatatcgtaatcaaaacctttgatgataaagcgcctgaaacagttaaaaacttcctggactactgccgcgaaggtttttacaacaacaccattttccaccgtgtgattaacggttttatgattcagggcggcggctttgagccgggcatgaaacagaaagccaccaaagaggcgatcaaaaacgaagccaacaatggtctgaaaaatacccgtggtacgctggcgatggcgcgtactcaggcaccacattcggctaccgcgcaattcttcatcaacgtggcagacaacgacttcctgaacttctccggcgaaagtctgcagggctggggctactgcgtctttgcggaaatcgtagaaggtatggacgtggtagataaaatcaaaggcgtcgccactggccgtagcggtatgcaccaggacgtaccaaaagaagacgtcatcattgaaaacgtgaccgtcagcgagtaatcgtggcgacactgtttattgcagacttgcatctgcaaacggaagaaccggcgatcgtcgccggttttctgcgttttttagccgtagaagcccgtcaggccgacgcgctgtatattcttggcgatctcttcgaggcttggattggcgacgacgaccccaacccgctacatcgtgaaatggccgttgccattaaatcgctggttgattccggcgtcccttgcttctttattcatggtaatcgcgacttcctgattggcaaacgctttgcccgcgaaagcggcatgacgctactaccgcaggaaaaagtgctcgacctgtatggccgcaatgtgttgattatgcacggcgatacgctctgtaccgatgatgccggatatcaggcgtttcgcgccaaagtccataatccgtgggttcaacggccgttccttaccctgccgctgtttatccgccgccgtatcgccgccagaatgcgcgccggcagtaaagccgccaacagcagcaaatcgctggatattatggacgtcaatgcgcagaccgtcgtcgccgaaatggaaaaacaccgcgtacagtggctgattcacggtcacacccaccgcccggcggtgcatgaactttccgccaacggccagcccgcgttccgcgtggtgttaggcgcatggcatcatgaaggttcaatggtaaaagtcacgccggataacgtggagttaatcgccttccccctgtaaatgttcgtcgaatcgtccgttacggcgcacacgcaaccgttttccttgcctgattatcatgctattctctgacacctcaaaagcagcgtgtcccgcaccacaggagttttaagacgcatgtcttcccgcaataatccggcgcgtgtcgccatcgtgatggggtccaaaagcgactgggctaccatgcaattcgccgccgaaatttttgaaattctggatgtcccgcaccatgtagaagtggtttccgcccatcgcacccccgataaactgttcagcttcgccgaaacggcggaagagaacggatatcaagtgattattgccggcgcgggcggcgcggcacacctgccgggaatgattgcggcaaaaacgctggtcccggtactcggcgtgccggtacaaagcgctgcgctcagcggcgtggatagcctctactccatcgtgcagatgccgcgcggcattccggtgggtacgctggcgatcggtaaagccggggcggcgaacgccgcactgctggcagcgcaaattttggctacgcatgatagcgcgctgcatcggcgcatcgccgactggcgcaaagcacaaaccgatgaggttctggaaaatcccgatccgcgggggacgctatgaagcaagtttgcgttctcggcaacgggcaactgggccgaatgctgcgccaggcgggcgaaccgctgggtatcgccgtctggccggttggtctggatgcagagcctaccgccgtgccggtacagcagagcgtcattaccgcagagattgagcgctggccggaaaccgcgcttacccgcgagctggcgcgccacccggccttcgtcaatcgcgatgtatttccgatcatcgccgaccgtctgacacaaaaacagcttttcgataaactgggactcgcgaccgcgccgtggcagctgctgtccagcgccgacgagtggtccggcatctttgaccgtctgggcgaactggcgattattaagcgtcgcgttggcggctacgacggtcgcgggcagtggcgtctacgcgcggacgaaaccgggcaactgccggatgactgctatggcgaatgtattgttgagcgcggtatccatttttccggcgaagtgtcgttagtcggcgcgcgcgctcatgacggcagtaccgtgttttacccgctaacgcacaatttgcatcaggacggcatcttgcggaccagcgtcgcgttcccacaggcgaacgccgaacagcaggagcaggcggaatcgatgctgtcagcaattatgcaggcgttgaactacgtcggcgtaatggcgatggaatgttttatcacgccggaaggcctgttaatcaatgaactggcgccgcgcgtgcataacagcggacactggacgcaaaatggcgccagcatcagtcagtttgaattgcatttgcgcgcgattaccggcttgccgttgcccgcgccggtgattaacgccccgtcggtgatgatcaatctgatcggcagcgagctgaattacgactggctgaagctgccgctggtacatctgcactggtatgataaagcggtacgtccggggcgaaaagtcggccatctgaatctgaccgacagcgatacgtcacgtcttagcgccaccctggaagcgctctctccgctcctgccgggcgaatacgccagcggcattatctgggcgcaaagtaagcttaaataaacagcgtgggcggcgcattctctgtcgccgcccgtcgcgatcacagacagatgcaggttcccgccctgcccgccagggtatcgtcaatacgcgacagcgcgccaatccatgccggctttccgcaccgcttcacatacccgcttaccgcggtcaccttcggtcccatcgcgccatcggctttggcaaacggcgccagctcatcgggcgaagcctgacgaatagcgcgctgctgcggcgttccccaatgttcatacaccgcatccgcatccgtcaaaatgatcagaccatcggccgctatctgctccgccagcaatgccgccgccaggtctttatctatcaccgcctcgaccccttcgccctcgccagcaacaggtaccccgccaccgccgctgcaaatcaccacatggccctcttttagcaataactcaatagcggtgctttcgataatctgacgcggcgccggggaagcgacgacacggcgcagatattttccatcacgtttcatatgccagccataagtcgcttccagcgccatttgctcttctggcgaataaacgggaccgataaacttttccggttcaagaaaagcaggatcgtccgccgatacctttattcgcgttaataccgcagtcaccggcggcatatcgggttcaagcgccagacgctgcgccagcatatagccgatcattccctgactttccgccaccagcacatccagcggataaggctcaacggctttccaggcaaggttctgtaaagccaacaggccgacctgggggccgttgccatgtactatcgccagccgatacgagcgggcaagtcgtgccagcgcaggcaccgcgtcggcaatattgcgatattgattctctgccgttagcgcttctccgcgctgcaataatgcgttgccgccaagagcaactaccaacgttttcattccctatccttttactatttgttgtccaagccagaaccccagcagcgtatccgcgccagaggtgtgccccagcgccagcagtccgtcaatcgccgtttctgtgcgagcatctcgtcgcagcgcatgaataaagtggagtaaaggcgacgcgaaataccccatagccgcatagcgtaaatagctgacgctcacgagcgtcgtcgcccgatcaaggctgccggattgggcaaaaaaattacgcccggcgcgttcatctatggcgccaaaataccaggccgccagcaacattcccgtcagcgtgtcctcatgactgggcgttaagcccggccctttacccagccatagccgccagtcagtcgcagcacctgcaagcgctgactgaaagcagtgacaaaactggcgaagttccggacatagaggctgagctgcggcgacggttaacggcccaaacagtcccgtctcctcactacgctgcatgtacgtcgcgttaaggcgcggcgacgcaagatagcgtggaacccgcagcgaacagcgcctctccggctcgcataaaagaaactcgccaatctgaataccggcagcggttaactgcggtttttcgccatcggtgagcacatcacgcaaggcgtcaaaatcgccgccgcgcagtatccaccctcctggactgaagccgctcccccgacggtgaagcgttaataactcaccgcttttcgccacaaaattaatagagcgacgccatacccctgacatctgccagggttgccgataatccgccgattgtcggcttgccataagaggatggatacgtttcatgagacgctctcttaacttacgcccatgctttccgccagcgcttccagcgcctgctcgaaacaggccagcggcgcacggacggttcccgcgccaatctgaccaattcccgcctctttatgcgcgatacccgtgttaatcagcggcgtaattccggtctcgaccacgcggcggatatccagtcccagacaggccccctgaaaatcccagccggggatttgtagctgcatgttgcgttcgagataaatttcagccatctcttcagaaacagatttcgccgcttccattcccccggcaccgacaaaacgcgttacgccaggcgcggcaatcatcgctgcgccgccaataccaaacgtttcagtaatggcgctgtcgcccatgtccgggttggcctgatcctgcgaaaaaccggtaaaaaatagcccctgcggcgtattaacaggcgcggtgaaccaacggtcgcccagaccgctaacccgaatgccaaacatatcgccattgcgggtcatcgccgtcacaatactgccggcgcgaatctgcgcgcccgcgtccatggcggctttacagtaggccatcgccagattaaggaagaattgatcggtgacgctcagaaaatccatcacttccgctatctgctgcttatcgtgttgcagacgggcgatatgcggcgccaacgtgcgcatcagcaatgcggaagaggcgatattgcgctggtggaattcatctcccatcgtaatgccctgcgccatcatcgcggtcaggtcaagcccccgctccagacgacccagcgccgcgcttaataccggcatcagcacatcgcgcatccagcgcaaacgttgctgaacatcttcgccataggcgccgaaacgcatcactttgccgatcccttcgttgagattgcagtacgcgcgattgccgtcggtgatattttccacgaccagcatcggcatactggctgacgtaataccgcccatcggccccacggcgttaacgtgatggcagggaataaagttgacctttccctgctctaacagcgcgagcgcgctcatttcatctttggcccatccttcaaacaggcatgcgccgatacaggcccctttcatcgggccggtcatctcttgccagcgcatcggcggcccggcatgaagaagcgttttcccctgattgagtacgctaattaatgaagaagctggcttcacatccagccagtgcggacgtgcgcgacgaatttgttcgatgactgcagcgttggcttgcgccactgatgtaaatatgggaaccccttattgcaaacgttctaacagacgagccagttttttattaccgccagcgacaggcgcccactggtagtgcaccacgggcataccggcagcctgtaaatccagcgcgaagctacgtaacccggcattaatcaccgctactgcttccagtaaccggggagctgatggatgagtagaagagagagtgggtcgaatcagttccgcggccaacagagtggcttcgggaagagaatccactaccgtgatgccggcatcttcgagcgcggcgatttgttgcgagcggcactgaggatcgcgttccgttccggtgacggttgcgatggcgaacagcggctggtcgctggcgcgtgcggcgcatgccttctgccaggcctgaatcagcgatgcggcgggatcggcggtcgcgccaaaaccaataacgacgtccactaataacacgcgtacctgcggttgtgcgccaagcccggcgataagctgattacgtaacgccgggtcaatcatcggatgtggtcgcccaacggtataaaagtcatcgcccagatcgataatctggtggccgtcagcgtcaagcatcatgccatggtgatgttccgtatccgtcgcgacgcccagatagccggccagcagtcccgccgcttccgccgccagcgttccgccggtatagagaccacgaatcacgccgcctgttgaaaccatttctttacgctgcgacgtcacgcgagacaataaacatgccagtcgggcagcttcatccagcgtcgaggcaaaccagacgttttcctcacgcgcaacgggagaggaaaaccctaagaacagcgctacaacgggtttcccggtggctttcatcgccgcgataatatgctgacgaaccgcatcagcaggcggtttggagacaaaggccagcacctggctcttttcatccgcgctgagtatgtccagtgccgttagcgcgctgatcccgccgacctcggcgctcaaatcgcgtccgccaagcccgatggcatgggtaatcccttcccccgccagcgcaatctgtgaacagagctcctgaataccggtgccggaagcgccaatcaccccgatgttgccctctggcatgacgttagcgaaagccagcggcgtattggcgatcatagcggtgccgcaatctggccccatgaccagcagtcccttatcacgcgcccggcgttttagtctgatttcgtcgtccagcgtgacattatcggagaagatcatcacgttcaacgaacgagccagcgcctgctccgccagttccgccgcatattcgccggccaccgataccagcgccagattcgcctctggcagtttctgacaggcgctttcccagcgtctgacctggattaacgactggctgccgctgcttccctgcgccaactgctgcaatgcttcttcgagctgtcgcacaatcacctgcgtaatgccgtcatctaccgcttcggtacgaatcgccacgcaaatgtcattgggcgtagcgccatgaaaatcgtcatgccagaaaccggtagtttccagcagcgacttattcgcaggcgtacccatcattaccgatacatcatcaacattttcggactcactcagctttcgagaaataatcattaagctgacagagtcctgaaaacacccttttttaataaaggcgtggatcataacaactccttaataattgcacccattgcaattgcacgagcagtgttaatgtgcgcttcacggtatatatccgggagggtaaatagagtgattaacgtcacatcaaatttattaacaaaagaattcaaacaacggctaaaggattagttatgattttctaaaaaagctttttatttaagcaaaaagataaaagccgcctgattatcaaataaattctaattatatttttttgcctgtctggatcacataatcattttattttcccggtatgttaatcgcagtcatgcttcacaccgtcgttaaaaaggaagacagatgaaaatcagtcgggaaacactccatcagcttatcgaaaataagctttataaagccggactaaaacgtgagcacgccgccatcgtcgccgacgtactggtttatgcagatgccagaggtattcactcacatggcgccgtacgcgttgaatattatgccgaacgaatttcaaaaggcggcaccaaccgggagccgacgttccgcattgagaataccggtccctgtacggcgatactgcatgccgataatgctgccggacaggtcgcagccaaaatgggaatggagcatgctattgaaatagccaaaaaaaatggcgtcgcggttgtcggcattagcagaatgggccatagcggcgccatctcttatttcgtccgccaggccgctcgcgaaggcctgattggtctgtctatctgtcagtccgatcctatggtcgtgccgtttggcggggcggatatttactatggcactaatccgctggcctttgccgcgccgagcgaaggcgatgacatcattacctttgatatggccaccaccgtgcaggcctggggaaaagtcctcgatgcacggtctcgcaatgagtccattccggagagttgggccgtcgataaaaacggcgcgccgacacatgatccttttgccgtcaatgcgttattacccgccgcaggcccgaaaggttacggcctgatgatgatgatcgatattttgtccggcattctgctggggctgccgtttggtcgccaggtcagttcgatgtatgaagatttacacgccggacgcaatttaggacaacttcatctggtcattaatccggcgttcttttcttcctgtgaattattccgcaaacatattagtcagactatgcaggaactcaattccgtgaagcccgctcccggttttaaacaggtttattatcctggacaggatcaggatattaaacagaaaaatgccgatatgaatggtatcgatattgttgatgatatttatcaatatctgatttccgatgccctctatctcaagtcatacgaaacaaaaaatccctttgcccaataattattgaaacaggaattttctatgataaagcattttcgccacgcgatagaagaaacattgccctggctctcttccattggagccgatcctacgggtggaatgacgcgtttactttattcgcctgagtggctggaaacacagcagcaatttaaaaagcgaatggcagaaagcggtctggaaacacgctttgatgacgtcggaaatttatatggccgcctttgcggcacacaatttccggagcaggtgattttaagcggttcgcatattgatacggtcgtcaacggcggcaatctggacggacaattcggcgcgcttgccgcctggctggcgctcgactggctaaaagcgacctacggcgcgccgctgcgcaccgtcgaagtagtgtcaatggcagaggaagaaggcagccgtttcccttacgttttttggggcagcaagaacatttttggcctagcgaatcctgaagaggtacgctatatccaggacgccaaaggcacaggcgttgtcgacgctatgcaggcgtgcggatttacccttcccgccgcgccgctcgctgcgcgaaccgatatccgcgcctttgttgaattgcatattgagcaaggctgcgttctggagagcaacggacagtcgattggcgtcgtcaacgccatcgtcgggcaacgtcgctacacggtgacgctcaacggcgagtccaaccatgcaggcacaacgccaatgggctatcgtcgcgatacggtgcatgccttcagtcgtatttgcagtcagtccattgaaaaagccaaacagcatggcgatcccctggtattaacgttcggcaaagttgagccgcagccgaatacggtcaatgttgtccctggaaaaaccacatttacaatcgattgccggcatacggacgccgcggtacttcgcgaatttaccgaacagttggaaaacaatatgcgcgccatctgcgatgaaatggatatcagcatcgatatcgatttgtggatggacgaagcgccggtgccgatgaacgccgaactggtcgcggccctcaccaggctgtgtgaaaccgaacaactgaactatcgcataatgcatagcggcgcaggtcatgacgcgcaaattttcgcgccgcgcgtccctacctgtatgattttcgtccccagcattaatggtatcagccataacccggcggaacgtaccaacattaatgaccttgctgaaggggtcaaaactctggcattaatgcttcatcaacttgcctggcaaaaataaggagccatcaatgggatatctgaataacgtcacgggttaccgcgatgatttactggcgaaccgcgccattgtgaaacacggtaactatgcgctcttaacgccggacggtctggtgaaaaatattattcccggctttgaaaactgtgacgtcaccatcctttcgacgccgaagctgggtgcttctttcgtcgattacctggtcaccttacatcagaatggcggcaaccagcagggctttggcggcgaggggattgaaacttttctctatgtcattgcgggaaatattgaagctaaagcagaaggaaaaacattctctttaactcagggcggctacctctattgtccaccgggggagatgatgacctttagtaacgctcaaacggaagacagccagctatttttatataaacgccgctatactcctgtcgaggggcatgccccgtggttggtttccggcaatgccagccagctggagcgtattcattatgaaggcatggaagatgttattctgctggatttcctgcctaaagagctgggcttcgatatgaatatgcatattctgtcgttcgaaccgggcgccagccacggctatattgaaacccacgtccaggaacatggcgcttatatcctttccggccagggggtttataacctcgacaacaactgggtgccggtgaaaaaaggcgactacatcttcatgggcgcttattccctgcaggccggatacggtgtaggtcgtggcgaagcattcagctacatctactccaaagactgtaaccgcgacgttatgatttaacggcgggcagccctcctgattatttttatttagctatgttggattttgccacggtgagaaccgtggatttttttatacttaacgagtcccgatgtcctggccaagtttgatgacgcgggcaatattacaggcgctgtggtagagattttgttcaccgttcgccagaacctccggcaaaggcgccagccgcggcaaaatactgaatactgcatcaataccgtgacgatggaccacttccacgccgtcgcccaatacgccggcaatgccgataaccgggacatgatgccgtttcgccactgatgcgacgcctatcggcgcttttcctcccgccgtttgcgagtcgattcgcccttctccggtaatcaccagcgaggcctcttttaccgcctcctccagcttcaccgcctgcataacaatctcaataccgggcttcatttccgcttccaggaagacgatagcggcaatccccattcctccggccgctccaccgcccggtatttgagacatgtcgcgtccggtcagggcatgtaaaatacgggcataattacgcaatccattttccagcgtctcgaccatttcaggcgtcgcccctttctgcggaccgaataccgccgccgcgccgcgtggccccaccaacgggttatcaacatcacaggcgacctcaatacgacactctgaaattcgcggatcgcgcccctgcaggtcaatgctcgccaggcgcgataaattgcccccttcggcgccaagcggcgttccctgcgcgtccagaaaacgcacaccgagcgcctgcgctactcccattccgccatccaccgtggcgctgccgccgatacccagaataatatggcgaattcccgcgtccagggcgtgacgaatcaattcgcctgtgccgaaactggatgcccgcagcggattacgcgcctcgggcgccaccagcatcaatccgctcgccgccgccatttcaataatcgccgttttgccgtcgccggtcaggccataaaatccgtttactttttcccccatcggcccgctaacgtccacagaaacccgtttcccgccggtcgcagccaccatcgcatccacggttccttctccaccatcggcgatcggtaaacaaacatagcgcgcatccggaaatacggttgaaaatcccgctttaatagcctgacagcatttatcagcgcttaagctctctttaaatgaatctggcgcaattacaatcttcattatgtctccttgttttctcacgttatttaatgcgttcccacggaataagattttccataagcactgccagtaggattcccaccagtaatccgttactaagcagaggacgaatcatcagtggaagatcctgtaaatagaccggaggaagccccatcaaaaaaatgccgacaaaaagcggtaacgccaggcgataaatattccgcgcggtaaacgtaatttgctggctaaaaaccaaaccggaataaagtaaaggtaaataagagaccagcataacggcgctgctgatcgccagtggaatagcgcaaaataagcgggttaacggcgttataatggcaaccagcagacacagcgcgctaccgcagataaaggatttgcgagaactgtcgccggtttgcgttaataaaccaatggaagatacaaaaggcgaaaaaggcacgaccgcaaaaggcaccgtcactaacgtcatcagtccggaaatcataaagcttcggcgataacgagaactgcccgacccttgatgcggataaaagatatcggtaccgcggatagcgccgtaagtgttgctgatgttgactaaccccgtcatcaccgccgtcacaataatacccggcatcagcgtgccgtggctgcccagcggaaaccatcgccagcttaattcacccggcggtaagtgtgacgaaggaaagcataaccgccatagcccccacccgaccacggtccctaccagtaacgcgtaacgggagatacgctgctgcaagaaaataatcatcgcgaggataaaacacatcaccgcgaccgccagcccaaagggggccaatttgattctggcgctggtatcggcaatgccaaaaggcagccccagcatgcctttaaaaaatattgaggtcagctgcgcgcccaaaagcagcatgaaaaaaaccattaccgccggcgtaaacaggcgagccagacggtgtcctaagccgctaatgccgataaatatcgtcaccatcgcggagatcgcgatcccgaccgacaggctggaggcgatatcgttcagcggcgtgccgcgagacgcctcgccaagcgtaatcgtaagtatagcgccccaccacaaccctgtcggcccttccataatggcgcggcgatggccgcaaaatgcctgaaccaggcaggccaacgcggtggtcagaaaagcgtattgtgtgagcattaacaggttatcagcgggaagatgaaaagcggacagcaaggtagggggaaccacaaccgtgttacagaaaataaagaaaaaccactgaaagccggacaatacactttcgcggttaataacagggaacatatccacaccttaaaatagagaatgcccgtcgtgacgacgggcattaaatcacaccggattactgctgatgtttaaggataaactgaccttttggcggcacagggaagccatgctcgatgtcataaataacatcgccgcgcaaaatcgttttggtaatacgcgcgccaatagtacggccaacatacggactgactttatggcgatattccagatcttcatttttcagaacatagctgctgtcaggctgaataaagaccaggtcagcatctttgccgggggcaatacgtcctttatgtttcagaccaaaaatatcggcggcgttggtcgccattaatttgccaaacatcggcaacgacataccgcgtttttgcaccgcttcatcaaacatgacgtccatgcagttttgcagtccggcaattccaccccatgcttgcatgatattgcctgctttcatttccggaggacatggagagtggtcggataccaggcagtcgatttcgccgttaaacagtttttcccacatccctttctggttttcctggtcgcgaattggcggagaacattttgccagggtgccaatctcttcgaactgatcggtatcgaggacaaaatagtgcgggcacgattcacaggtgacatcctggccttcctgacgcgcacgcgttacttcctctaccccctccgggctgctgatatgacaaacgtgcagacggcaacctgccgctttcgccagatacagcacgcgacgaatggcttccacttcagtaaataccggacgtgaggcgacataatcatgcgccgttacgcgaccttcgcgtttagcttcttcgcccagctcatcgcaaatcagagcattttcgcaatgtaccagtaccgtctggtccatctctcccagtttttgcgcgcctttgtaaaactgccagtcattaacgtcgcgaaaatcattatcgatgccacgatcgccgcaggtggcgacaaagcacttgaagccgacaacgcccacttcgtccagctcatgcagccgatccaggttataagagaccaaaccgcccaactgcgcggcgtcgatggtcaatttaccttttgccgcgtcaaacttgagttcaatcgtctcacgatcgaccgtcgccggcagctgattgagcggcatctcaatcatcgtggtaataccgcctttcgccgccgcgcgcgtaccggtttcatagccttcccagtgggtacggcccggttcagaaatgtgggtatgcgcgtcaaccatgcccggcgaaacgatcaatcccgtcgcatccagcacgtttttcgcttcccccaggttctcgccaatcgcggcgatttttccgccctggacggcgatatcgataactctcgcttcgttttctaagatgacagtaccgttcttaataattaaatcaaaagacataacaaactccttgtatggatacagatagtttttaaatagtgcacacttcattaaatacgcttaatattttttcaatagttaacctgcgactttttgctctcctgtattttcaaaacccgtgcgtttcttcagtagcgcataagcaacgaacgcaactattacgcctacaaaccaggacacgcgggataaaggctccataaatggtataaacttgccgcctaatgacagaatgactgcgaccagggtgactgaaaatgcagtcaggttaaatccattatcataatatttgtaatcaccgctggcggtgtatagctcatcaagattaatttttccacgcattaccacaaaataatgagctaacattacgccgattaccgggccaagcataccgccgataatatcgaggaacagataaatactgtcctgattctccattaatttccatggacaaatcagtagactgataatactggcaatcattacgccatttttatagttaagctttgtcggggtaagcgccgcaatttgataccccgcaggtataatattaccggtggcgttggttgaaattgtcgtcatcagaatcaccagcactgcaaagaatgaagcaaacaggctgtcccagcgctgcacaatatccagcacgttccaggtatccataccataatgaatactggctccggcaataatgcacacgctggctacggcgaataatatatacgctacgataagccccaatgtttgtcccaatgcctgagcgcgaaatgaatgcgcgttttgcgtgaaatcggacgcgctcaccgctggcgcagcccagacggcgactacggcgttaatcaccactaggaacagaaagccgctgtgctctgctttttgcacgcctgaaggcagatagtccaaaatcgggccaatgccgaccagcgatattgcccaaatagccatgccgccaaagacaatataaatacatggattgaggatagcggtaaatttatttaatactttaccaccgccaaaaccgatgccaacgttaatgatccaaaaaattagaaaagtaattagccctggcagtgaaaaacccagcagcttgaaatctccgcctaatgtctaaaatcctggccagatcttcccaattaaaataagaaatgccagcgatcccgcgtaacactgtaagccgaaccacataattgccgcgattccccctcgtaataatccagggaatagcgcgccgcggacgccgtaagaacctcgcaatatcatagcaaaaggaacgccatatttgctgcctgccgcgccattcattaccatcgccgccgcaataaataatgcgctgataataatggccaacatgatattaaatgttgatagccccagtataaaaaaaccgccgaccataacgtaatttggcacgttatgtacagatcccatccataaggtgaaatagttaaatgctttccagtttcgttgggtttctgttttaggtaataagtcttcgctataaccgcgttgctgatatagctctctttgatgttccataaatccctcttttcacgcatcggataacgttgttatgggtttagctatgaggaacaaataaatataaaataaagaaatagtagatataattatttttaagctgaagcaatacgttgcgttgctttctttttatataatgtgacagcagcaaagatcagcgttccggtaaccactaaacatgctgaaatcacaaaactgatctccttcgaccccgttacatccgaaataaatccggtcaacgttggggcgacaaccgctgaactcatgccaaagaaattaaaaaggctgaaagctcttcccagactttttgccgaagcctgttcagatacaaaggagatcaggatcgggtctactgccattttccctagcaagccgtatagcgtcaggctgaccatcagcatcgtggtattcggggacaaaaccgtaaacgccaacattgccgccgccacaatttccagaccgagaataaccttaactttactgttacggaatttatctgacagatggctaaaaaataacgcccccggtacgccaaccaccgccaccagagctgatgccagcccgatagctccgccatcaaatcctctttcagtctggagataagaaggcagccaggtcactatcaaataataaccgtagcaggtacagaaatagaggaagtaaacgctacacaataaaccagagaataaaggcgcgcgtttctcatcttccgtaacggtttgggtttgcttttccgcttgcgcagagtcgcttttggctttaccacgaatgaccagcgtaaagacgcacagcataattactaatatcgcggccacgatatacagtacattttgccaggccatgctcatgttttttactaatacgctggaaccgattaagccaatccccatccctatagccgacccgctgttgataatcgcgttggctaatgcccgacgggcctgcggcacgtttgccgaagagagtgaataagccgaactaaagaaagaagcgcatcctccgcctgccattagcgaccctgtatagatcatggccaggccattggctttcgcgatacagagtgtaccaataataaaaagcgtaaatccggccatcagcatgattttttgaccgaatttatcgaccaatattccgcaagggatttgcatactgcagtaagcaaaaaagtaaaaacttgcaatggcgcctatttctgcattacttacattgtctaaagatgcctgaatttctggataaattggcgtaagcacggtgcgatagatccaaatcgctacccagcccagactcattacgacaacaatttgtttccagtaatcaatcccggattttttagtttcactcatgttcttcacctttacagagtgttccttgtgaacaggtatcgctgcagccgcagcgatacacataattaggacaatttatgattggccattaattccagcgcctgtaccattgccgaatgatcaagctggctcccgccatttgccgcacaggtattgaataattcctggcaggtcgccgtattcggtaaattcagcgccagcgcttttgcgctttgcaatgcaagattaaggtctttctgatgaagcgcgattttgaaaccaggctcgaacgtccggttgatcatccgctcgccgtgaacttccagaatgcgtgaagaggcgaacccgcccattaacgcctggcgcacgcgtaccggatcggcgcctgcttttgaagcaaacactaaggcttcagaaaccgcttcaatattcagcgcaacaataatttggttagccaccttacaggtttgcccatccccattgccgcccaccagggtgatattttttcccaggatgtcaaagagcggtttaacgcggtcaaagactttctgctcgccgccgaccataatcgacagagtgccttcacgcgccccgatttctcccccggaaaccggggcatccaggtaatcagcgtccatttcattaacgcgctgggcaaaacgtttggttccgataggagaaatagaactcatatcgacgatggtttttccctgaagcgatgttttggcgcaaccgtgttcgccaaataacacctcttcaacctgcggcgtatccggcaccattatgaagatgatgtctgcgaattcagtcacctgacgtgcagtctcaacatttaccgcccccagcgagagcagttcgtccgcgactggaccaatagtcgtaacgtgtaattgatgaccggcgcgtgccaaattgatagccattggcgagcccataattcccaggccaataaatcccagtttcatatacaacctcttttattgctttcggtgtttccagattcaggcaacacaatccccttccaacacagtggaaaaaaaagcgctgcccgaattattctgcgttttaacggtactgattaatccacgataatcccgcttccgcggtagtcagtggtttatattcacatccaacccagccatcataatcagactgtttaatgacattaaaaataaagtcataattgatttccccggtccccggctcgccgcgacgcgggttatcagcaatctgtaaatggcctattttatcggcccatgccgtcatggtttgcgttaattccccttccatgcgttgcatgtgataaatatcatactgaattttgatattatcgctgccgatatccttaattaatactaacgcctgttgagtgccggtgagatggaatcccggcatatcaaagtgattaataggttcgataagtaataaaatgtcttctttcgccagcatatttgccgcatagcgcaggttttcgaccaacgtgtcgtagatctccgttgcggagaatcctgacggcgttttacccaccagacaatttattttcttattgcctaacgcgcgtgcatagcggattgcggccgctacgccatcgcgaaactcttcttcgcgcccaggaatacaggcaattccacgttcgccagccgcccagtcgccagccggtaaattatgtaacgtatgttccagattattatccctgagcttacgttttaacacttcgatgtcgtcatcgtagggaaacatgaattccacgccgcgaaatcccgactgcgccgctttatcaaagcgttccaggaaatcatattccgtaaacagcatagaaagattggcagagaaacgtaacatcgattacctcccttactcatatttcataaaacaggtttctgttggcgcatctttcgcactatccgcaacctcttcaaactcggttacgttatccagttcgtcgcccatggaaatattggttacgcgttccagaatgacttccaccaccaccggaacgcgatattgcgccatcagcgctttagcttgttcaaatgcaggcgcaatatcttccggtttaaagacacgaattgctttacagcctaacccttctgccacttttacatggtcaacgccatagccattcacttcgctggagttgatattttcaaaggcgagctgcacgcaatagtccatgtcaaatgcgcgttgcgactggcgaatcagaccaagataagcgttgttaaccagcacatggatatacggaatgttaaactgcgcgccgacggctaactcttcaatcaggaactggaagtcgaaatcgccggaaatcgccaccacattgcgttgtggatcggcagcacaaacccctaatgccgccgggattgtccagccaagaggccccgcctggccgcagttgatccagtgtctgtctttaaacacatgcagcatctgcgctgccgcgatttgcgacaatccaatggtggtgacatagcacacatcgcgaccaaaggctttgttcatctcttcatagacgcgctgcggcttcactggcacgttgtcaaagtgggttttacgcagcaaagtccgtttacgctgctggcattcgtccacccaggtcttccggcatggcaaacgccccgctttttgcatctcctgcgcgacatcgatcagcaacgttagcgccgctttggcgtcagaaacgatgcccagatccgggcacaacacgcggccaatttgcgtcggttcaatatcgatatggatgatttttcgaccctgagtatatttctcaacggaccccgtatgacggttggcgaaacggttaccgatgccaaaaaccatatcggatgccagcagagtggcgttgccgtagcggtgcgccgtttgcaggccgaccatccccgccattaaggggtgatcgtccagggtacagccccagcccatcagggtagggatcaccggtacgttgatcagttcggcaaactgctgcagcagtggcgcggcgtcggcgttaataaccccgccgcccgcgacaattaccggacgctcggactgaatcagcatctccagcgccttttcaatctgtactcggctggcggctggcttatataccggcagcggctcatacatatccggatcgaattcgatttccgcaacctggacatcaaacggtaaatcaaccagcacaggacctgggcggcctgagcgcatcagatgaaaagcctgctgtaatacgcgcggcaccagcgccgcctcacgaaccgtcactgccatcttgctgactggttttgcaatcgcttcaatatcgactgcctggaaatcttccttgtgcagacgcgctcgcggcgcctggccggtaatgcataaaatcgggatagagtcggcagaagcggaatagagcgcggtgatcatgtcggttcccgccgggccggaagtgcccaggcagaccccaatattacctgccgccgcacgtgtgtagccctcagccatatgcgaagcgccttccacatgacgcgccagtatatggcgaatgcctccatgcttacgcattgcagaatagaaggggttgattgcagccccaggaacgccgaatgctgtggtgataccttctttttccagcacatacattgccgcatccacggctctcatttttgccattttattgctacctctttttattggaaaaagtttccaacttttaaaaattttaaaaaagtcccgctccagcgagcgggatgcggctcaggctacagggggttttagcccaagcgccgtactgatgtctttcgcggtatcccgtaccagttcaccctggctgataaagcgatcttccgtcagccgggaagccggtcccgatattgagatagcggcgaccacgctgcccgcatcgtcatagatagcggaggcgatacaattcagcccgacaacatgttcttcctggtcaacggtatagccctgttcacgcgcccgctccagatttttaagcaggataggtaaatccaccaaagtggtcggcgtaaaccgccgcaaaccagtattgacaacgatccccaccagctcttcttcggtgagcgggtaaagcagcgcttttccggcgccggaagcatgtaacggcagacgactccctaagggcgcgcacattctgaccatcgatttgcactccttttgaccgattaacaccgcttcattaccgttgcgaatcgctacgttgaccgtctcgccagaaagcagcataagtcggtgcataaagggcccggccaccgagaggacatcgcgattatgaatatacgcagagcccacattaaatacgcctaaaccaatatgccaccagccaagctggctatcctggtacacaaaatcagccgcttgcagtacctttaacaggcgaaacgtcgtagaaagcggtaaatccaggctgccggaaatatcgctaactgatgaactgccgccgcttctttcgagatattgcaatatcgctatgcccctctccagcgcctgagcgcctttctgcgcagtcggctctgcctgtcctggcctgccgcgtcgtcttacttccgtcatatttacgttaactccggcccaaaatatgagcataaacaatgaacaatatgttcatcttatgcaagaaggccaatagcgtcacgcaaaacagagttcatgtgtcgggatactttcaacatcacagttatcgctgccaccgcgatccaccgtcagaaaatcggtaaccgtctgccacgcaaacagcgggtgatgccatacattacggtgataattgacgccctgccgtccattgctaataaacgcccgcagcgtggagagatcgggtttatcatcgccgagcgcgacaataacgacaaaagcctcgccgttcatcggcacaaacgcctgcgtacctaaaggatgacgttccagttcatgtaccacaataggcatcgcggctggttgcgccctgttaatactgatcagcgtgcgatcctgctccagaacttcaaccttcgccaggtcgtgatatcgctcaactaacccgttgtttatatgaaaaagtcacgttcctgcgtctcaataacatcgccataggcgctgaacgtcttctgatctaacggtaatacctcaagtttcattatttttcccttgtagctcgattccgtttaaccgcggtttggactctgtccggtttcaataccatgcaatctaaaaccttcgggatttaacatcaacataaaacttggaatatttttccaaaagtagatttagaccacaaatcaaacatggctattatgtaaaactacttaaaaatcataggaaaacaattctggttttatcaggatcgtaaggaggcgtctgacgatgtttgacccggaaacactgcgtacctttatcagcgttgccgaaacggggagtttctccaaagcggcggagcgcctgtgtaaaaccacggcaactactagctaccgcatcaaactgctggaggaaaataccggcgtagggctgttctttcgcacaacgcgaagcgtctcgttgacggcggcgggctctcaccttctctctcaggcaaaagactggcttgcgtggctggacagcatgcctgacgagctacgccaggttaacgacggcgtagagcgtcaggtcaatattgtggtgaataacctgctctatagcccgcaagcggtcgccagtctcttatcgtggcttaatgcgcgttaccctttcacccagtttcacttttcccggcaaatttatatgggcgtctgggattcgctcctgtatgaaggtttttcgctggcgattggcgtaactggcaccgagccgttggctaatacctttatgctcgaccctttaggttccgtacaatggcgttttgtgatgtccgcggatcatcctttagctcacgtcagcgggcctctaacagaagcgcagttgcgccgtttcccggcaattaatatcgaagacagcgcgcgtacgctgaccaagcgggtagcctggcgccttccggggcagaaggaaattatcgtgcctgatatggaaaccaaaatcgccgctcatctggcaggcgtcggtatcggttttgttccgcagccgctttgtcaaacgctgatcgacaaaaacgaactggtgagctgtaccatccctacgatgcgtccgccctcaccgttaagcctcgcctggcataaatttggcggaggcaaagcggtagaagacattgtgaaattatttacccaacgacaacccgaaatagccggttttttatccattttcaacacggtacgctgttaaaaatcaagccactttgcgaattggcgcgtaaaatagcgcaaaggatgatttaaggttacgttttacgttatgcaagacagacaaaaagcacaggactatcgcgcactcctccttgccgatacgcctttaattgatgtacgcgcgccgattgagtttgaacagggcgccatgccgggcgctatcaacctgccattgatgatggacgacgagcgggccgccgtcggcacctgctacaaacgtcagggcgcggatgcggcgttagcgctggggcatcggctggtttgcggcgacattcgccagcagcggcttgaggcctggaaagccgcgtatcaacgtttccccaacgggtatctgtgctgcgcacgcggcggtcagcggtcacatatcgtacaacgttggctgcaagaaacagggattgactgcccgcttattgaaggcggctataaagcgctgcgccagacagcaattcaggcgacctggcaactggcgcaaaaaccgatacttttaattggcggctgtacgggcagcggcaaaacgcaactggtacgacaacagcccaacggcgtggatctggaaggtctcgcgcgtcatcgcggctcctcttttggccgcacgctgaaaccccagctcagccaggccagttttgaaaacaaacttgccgttgaattgctgaaaattaacgcgcgtcagacgctaaaaaggtgggtactggaagatgaagggcgaacgatcggcgccaaccatctgcctgagtgtttacgcgaaagaatggcgcaagcccccattgcggtagtggaagatccgtttgcgcttcgtctggaacgactgcgtgaagagtatttcatccgtatgcatcacgacttcacccacgcctacggcgatggggccggttggcaggcatatagtgaatatcttcatcatggactgttcgctattcgccgccgtctggggttgcaacgctttgccgaactgacggacacgctggatagggcgctggcagagcaattatccagcggcagcaccgacggccatatggcatggctggttccgctacttaacgaatattacgacccaatgtatcgctatcaactggagaaaaaagccgcgaatatcgtttttcgcggcacatggcaagacgttgccaactggctaaaagcgcaatagcttatttttattgccggctgacgctacattgagccggcttagtgtctgtcgcgcttgtcggcacgttttgccagccagtcgcccagcatctgaacgacctgaaccagcacaatcagcgccactacggtaacaaccatcacttcggtttcgtaacggtagtagccatagcgaatcgccaggtcgcctaccccgccgccgccgacaatcccggccatcgccgagtagccgattaagcttaccagcgtaatcgtcaggccgcgcagcagccctgcgctggcttccggcaacagtacggtacagataatacgcatcggactagcgccgaatgccagcgccgcctcaataatccctttatcgacttcacggagcgcgctatctaccaggcgtgcataaaacgcgattgcggccaccgacagcgggacggaggctgcaatcgggcctatcgtattgcccagcaaaagctgcgttagcggcagtaacagcaccagtaaaataacaaatggcaccgagcggataatattcaccagaaccgaggcgacaagataaataaaacggttctgccagaacagatgacgatcggtgacaaaaatcagaaaaccgagcggtagaccgccaagaatcgccagcaccgttgaaatactcaacatctggaaagtttcattgaacgccagcgttaaatccggcaataaatcatccacggatcacctccacctgtgcagtacgttgacggatatgctccacggcggccgccaccgccgttggattatgcggcgcggttaattgcaccaccagaatgcccaacgcgcgttcgccgatatactcaatcttgccatgcaggatattgaccgcgacgccaaacttgatcgccacctccgacagtaccggctgctccgccgaatcgccgataaacaaaattttcagcaactgcccgggcaggtgttcccgtaagcgttccggcagggtcaaattaagggtatgagacaccagttgctgtgtgaaagcgtgttgcgggtgggcaaacacatcaaacacctcgcccgattccacaaccttaccgcccgacatcaccgccacgcgatcgcaaatagatttgatcacgttcatttcatgggtgatcagcacaatagtaatcccgagctgcgcgttgatctgtctgagcagggccagaatcgtggcggaagtttccagatccagagcggaagtcggttcgtcacacagcaaaacatccggatggttagcgatggcgcgggctatccccacccgctgtttttgcccgccgctgagctgtaccggaaaacagttcgctttatcggcaaggcccaccagcgttaaaatttccgccacccgcggcgcgattttgctgcgttcccagccagccgctttcaggctaaacgccacgtttttcgccactgtccgggtatgcattaagttaaaatgctggaaaatcataccaatacgctgccgcgcctggcgtaacgcttttccgtccagcgcagaaatttccacgccgttgacgttgacgcgcccctgactgggacgcgttaaggcgttcagggtacgcagcagagtgctttttcctgcgccgctggtaccgacaatgccaaaaatctcgcccgcggcgatatgcaggctcacatcatccaccgcgcgcgtgggggtaccgcgaccggcggtaaaatcgacgcagactttttctatttcaatcatattcacctcagaaattggggatggccaccgctgcgatcagggtgtcgcggtcatccattccggtttctggaaggcgctataaatattctttggatcgtcgatgaccgcgcgataagccggcgatttcaccgcctcgacaatatctttggcaaacggcttatcggcatcttcactgcgtaccgcaatgatatttttcagattctcatccaggtgttcctgcttaatcgcgctggagagatcgagtcctgccgccaccgcaaagttcccgttaaccagcgcgccggtcacgccgtccagcgtgcgcggtagctgtgcggcttccagcggtttgaaaaccagtccttttggattgctggcgatatctcgttcagaggctttggtcggatcgatattgtgcttaatcgtgataagccccaacgattgcaggaagcgaaggccgcgcgccaggttggtcggatcgttggagagggtaataatgtccccttttttaagcgcatccaggctgttgattttacgtgaatagaagcccatcccggcggtcggtaccacaataagtttgctgagcttcagccctttgtcagcggtgaatttgtcaaaatagagggtatgttgaaagaggttggcgtcgatgctgccgttagctaacgccatattgggctggacatagtcgctaaactcgcgcaccacgaccttataccctttttcttttaatgtcggcgcaatcgcctgcttcaccatgtcgccatacggccctggcgcgacgccaaatacgatcgtttgcggggaaccatcggcatgggcaaactgtaatccgcaggccagtaatagcgtgctggccgcaatgcgtaaactctgacgcaatcccataatttctccattttaaatagtgtgatgctgtgccggatgccgttcatgcggcatcgtctgttttggcccaaacgaaaggctatttcttaacatgacacagatcacagcctgctgtccttgaaattatttcatgatgtttcctggtgtgtcgttaaatgtacgaggcaggcgctcaggcgtgtgtcaggcgggaatggcgtaaagggaaatgccggataagacgtcttaacgccaacatccggcacaggaaaacgctttagaaatcgtaacgcagacgcaccaggttcatatcgcccagattgtcagtgctggaggtgaaaacatgttcataatcaacgcggaaaccataatccagttggaaggtgatccccacgccgttatcggtgcgcagatagtcgcggccattcacatattcaatgcggtcgcccataaagtacggttgaatagctttcacggcatactgaccaatcgggaaagcgtaaccgacaaaatattccagaccccacgcatcgccggcaaagtaatcattcacagacacttttttggtcgtcataaagttctgataccaaccgccgcctgcggcaatagtccagttttccggcgtccagcttaacgcggtaccgacaatattttgatcgtaagttttattgccgttgccgcgcatctccgcacgggtatagttccatgccgtcccccaggtcagatcgtcggtgagatggtaatccgcgcctaaagaaccgccgcctttacgtttgtaattcaggccgttattggcattataatcgtcgctgaacagataagacgcgtagagatcgacattgccaatgcttttcttatacttcaatgacttacgcgtacggtaagaaccatcgtagtcgccgttaatcccgttgcccggcgcctgacctatcatgtcgtaatcccagatatcggtttttacgcccaccacatcgtaataaatgctgttctgttgaccgaaggtcagcgttccccacgtcgcgctcttgaagccagtatacagcatacggcgagtggtatcagtcgtgcccttcgcataatggttatcccagtcaaataccgcagggatattgacgcccagctcgtaatagctaatccaactgatatcatcaaacagataataatccgcggcgaagcggaaacgcgtcccgccatcaaaaccattacgtttataaccgttcgcgccgtcattaccggtcatattctggaactgcggacgaatactcccgccaacggtgaaattgagtcggctgagtggattacccgcctggggatcttgttttaaaacggtgatttccgcctgagtggcgaaaggcatgaaagccactgccgcgccgatcgatgccgccaacgctgttattttaattgtcattatattttccttgatagatagccaatccaaatcatttagcaggcaaataataactgttataaaaccttacgtgttgtgtattttttaatgatttgtgctactaaaaatcaaggagttatcaatttgtgcgactaaaaaagtacgcgccgttttaaaaaccagcgcgaaattattcacatcatgaatcatccgctaaactggcggaatagcgctttgcctttaagcaaacgaacgccaagccagccgccgcatacggaaagcagcagcgcgccgcaaaacggcagtgcgacccataaacgccagtccggctcccaggggaaatcaaaaacgttgatttgtaagatcgccagcgccgtctccgcgccaatcgcggcgaccagcccggcaactaaccccagcatggcgaattcgcaccagagtgtggtacgcaacagtttctttccggctcctaacgtgcgccacaccaccagctcctgatggcgctgacgcatcccgacctgtacctgggccagtaatagcaacatgccgcagagagtgactagcacaaccatcacctccagcgcccgactgacctgctccagcacctgtcccacctgtttcaggatcgccccgatatctaacaggctgacggtaggaaactcgcggttaagctgcgttaacatgccgttgccattctcccagcgaaaactggtcaaccagctttgtggttgcccgtccagcgccccggaaggaaaaatgaagaaaaagttgggccgcaggctttcccagtccacttgacgcaggctggtgactttagcgctaaatgcctgggtatcgcccataaaggttacgctatcgccgagtttgacgttcagccgcttcgccagcccctcttccatagagacttcgcccggttttggcggccagtgaccggcgaccagcggattatgcgccgggcgcgtatcctgccaggtcaaattcagttcacggttgagcgactcatcctgctgaccttccgtcggattaccgtttatctccgttaaccgcgcccgcacaatcggataaaacgtctgcgggatcacctgatgttccgccaaaaaggctttcagcggcgcgacctgttctgaagcaatattgataaggaaatagttcgggctttccggcgggagctgctgttgccagcgatcaaggaggtcgccgcgcagcaccagcaagagcgccagcagcataaacgaaagcgaaaacgccgaaagctgactcaacgttgaccacggctgacgcagaagtcggctgacggccagacgcagcggtagcgacgtcaacgtcatgccgcgcaacacgttaagcagcatccagcccaccagaccgcacagcagcgccagtatcacggcgcccgccagaaccgcccacaacagcatactttcgcccatcaatccggcgagcagcgccaccacgacggcgcaggcgacaggcaaataaatttttaacgaccagacgcgagcgacaacatcgcggcgcagcacccgtagcggctggctcgccagcaacaatcgataaggccgtaaaccgaccagcagagagatgaccgtcatcgcgcccagcgcccacagccagggccacaggctggcgggcggcaaatcggcgggcaataccggttttagcagcaccagcaatatgttttcaaacagtaacccaatcgcgcctcccgtgacggcggaaagccccagcaccatcaaccactgtccgatgataagtttacgcaactgggcccggcccgcgcccaacgtttttaaaatcgccaccagatcgtagcggctacggcagtaatggctcatcgccaccgcgacggcagctaccgccagcagtagcgttaataacgccgaaagcagcaaaaactgctgcgaacgttcgagcgatttccccaatgccccgtcatcctgctccagtccgtaccagcgatgttccggtttaagctgcggtaacagccagctttcatagccagcaagctgttgcggcgttccgccgaatttataccgccacatcacgcgactccccggctgtatcgcaccggtttttgccacatcggccatattcatcatcagacgcggcgccatctgaaaagggttaaatccggaatccggctcctgcaccacttcaccagcaatacgcaaggtcacgtcgccgacatcaatggtatcgcccgttttcaaattaagcagcgccatcagacgcggcgccagcagtacgctacccggctgcggtttcactccgcctggacgggtttgcaattcgccgtacatcggataaacgctatctaccgccttcacgctggccagttgcggcgtatcgccggcaaacgtcatggtcgcaaaggttaactgctcgcccacgttaaggccgcgtttacgcgcctcttcaagccaggctttcggtacctcccgcgaactttgcagcgtccgatcgcctgccataaactcgcggctttgctgacttaaccctttttccatccggtcgctgatactgccgagcgccagtacgcaggccaccgccagactcaacgccagccagacaataatcagcgacggcgagcgccattcgcgccagaaccagcgggctatcatgcctcctcctgtaactgaccgttgaccaaccgtagccgccggtcgcagcgcgccgccagcgccgggtcgtgcgtcaccagaatcagcgtagtgccgtgctcgcggttaagcgaaaatagcaggtcggcgattttatctccggtctgacggtcaaggttgcccgtcggctcatcggcaaacagcacatcaggacgcccgttaaacgcgcgcgccagcgctacgcgctgctgttcgccgccggaaagctgtgccggaaggtggtcaagccgttttcccagtcccagttgttcgagcagcgctttcgcccccgccttactctgaccgctgttttcaccgcgtagcagggccggtagctcaacgttttccagcgcgttaagcgtaggaataagcatgaaggattgaaaaacaaaaccgacatgctgagcgcgaagctgcgcccgcgcctcttcgtccatctgatgaagcggtttcccgaccagactgacctctccgctactgccgtcatccagtccggcgagaatcgccagcagcgtagattttcccgatcctgattcgccaatcagcgcaatggtttcgccgcgtttgacaaccagttcaactccggtaaggatggaaagctcatgctcaccctgaccgacggacttcctgagacgatgaacttcaacactgttttccgctggcatttgcccttcctgtttttgatcctgttaactttccgtgccgccgccgcagacaccttattaattctgggcgatagcctcagcgccggttaccgtatgaccgccagcgcggcatggccgtcgctccttaatgataaatggcaaaacaaaacgtcggtcgttaatgccagtataagcggggatacctcgcagcagggactggcgcgtttgccggcgctgttgcaacagcatcacccgcgctgggtagtggtggagcttggcggcaacgatggcctacgcggttttgcgcctgcgcaaaccgaacagacgctacgtaaaatcattcagacggtgaaagccgccgatgcccaaccgttactgatgcaaattcatctgcccgctaactacggtcgccgttataatgaatcctttagcgccatttatcctaagctcgccaaagagttcgatattcctctattaccgttttttatggaagaggtatatctgaaaccacagtggatgcaggatgacggtattcatcccaaccgcgacgcgcagccgtttattgccgactggatggcgaagcagttgaccccttttctctcctgaatcattcgagttgcatgaaggcggcacgtaagagaatttccaggagcatagatacctatgtgactggagtaaacgaacgcacaggcaacttgaagtatgacggatatagttaaccacgactcttaaatcaacggagatcctgacaggtaaagttatgcaaaaatcggtcttaataacaggatgttccagcggaatcggtctggacagcgcgcttgaacttaaacgccagggctttcaaatcctggcgggctgccgcaaacctgatgatgtcgcccggatgaacagtatgggatttaccggcgtgttgatcgatctcgactcccctgaaagcgtggatcgtgccgccgatgaagtgatcgccctgaccgataatcgtctgtatgggatctttaacaatgccggctacggcgtgtatggccccctttccaccatcagccgtgaacagatggagcaacagttttccagtaatttcttcggcgcgcatcagcttaccatgcgcttacttcccgccatgttgccgcatggcgaaggacgcattgtgatgacctcatcggtgatggggctgatttccaccccagggcgcggcgcttacgccgccagcaaatatgcgctcgaagcctggtctgacgcgctacgtatggagctacggcacacaggcattaaagtgagcctgatagaaccggggccgattcgtacccgttttaccgataacgttaaccagacgcagcgtgataaaccggtagaaaatcccggcatcgccgcgcgtttcacccgcgatcctgacgcggtagtagcgaaagtgcgtcatgcttttgcaagcgataaacccaggctgcgctatcccgttacgctggtcacctgggcggtgatggcgctgaaacgcatattgccgggccggatgctggataaaattttacaaagctgagttgaagcgcgcccgtcagcccccatgtaaacgtgacacagacaaaagagagcgacgccatgtccgtacagaacattgtcaatattaatgaatccaacctgcagcagaccttagagcagtccatgaccacgccggtactgttctatttctggtctgaacgcagccaacactgtctgcaattaacgccagtgctggaaagtctggctgcccagtaccacggtcagtttattctggcaaagctggactgcgacgccgaacagatgatcgccgctcagtttggtctacgcgccatcccgacagtctatctgttccagaatggccaaccggtcgatggtttccaggggccgcagccggaagaggcaatccgcgctctgctggataaagtactgccgcgtgaagaagagctaaaagcgcaacaagcgatgcagttaatgcaggagggcaactacgttgacgcactgccgttactcaaagacgcctggcagctctcttcgcagaacagtgagattggcctgttactggcggaagcgcaaattgcgctgaaccgctctgaagaggccgaagcggtattaaaaactatcccgctacaggatcaggatacccgttatcaggggctggtcgcgcagatcgaactgcttaaacaggcggcggatacgccggaaattcagcaacttcagcagcaagtcgcggataatccgcaggatgcggctttggcaacgcaactggcgttgcagttgcaccaggtcggacgtaatgaagaagcgctggaattgctgttcagccatctgagaaaagatcttgccgccgccgagggacagacgcgcaaaaccttccaggagatccttgccgcgctcggcaccggcgacgcgctggcgtcgaaataccgccgccagttgtacgcgctactgtattaatcctctcttgcctgatggcgcgcttatctggcctacctgtcgtcctcaggccggataaggcgtttgcgccatcatccggcaactatcatgatttcttgagcggcatcactaccaactgatgacgcgaattatagaacttccggtaggttaaatagcaggcaatgatggtagacaggctggctgtcgataacagcataaacgttaccataatttgatatttaatcgcttttaccggatcgatcccggcaaaaatcagcccggacatcatccccggcaggctcaccagcccaacggtctttgccgagtcgatcgtcgggataagcgatgcgcggatgctatcgcggataagcccggcggaggccattttcggcgttgcgcccaaacttaatttttcctggatttgctgctgctcgctatgaaaacgcagccccagttggttgtagcacagccctaccgccaccatcgcattgccggcgaccatgccagcgatgggaatcacctgcatcggcgcaaattcaatcgaaccggtaagcaccagtaccgtcagcgttagtccggcgccgacggtgatggcgataaacgaggagagaaatgccttatcgatatatttactgcgcttttgcgcgttccatgcggcgttaaaacagatgaacagcaccatcagtagcgtcagggcggcatgattaacgccaaagatgtatttcagtacatagccgacaataatgagctgtatcaccgcccggcatacgctccacagaatatctttttccagcgccagcttttcctcgtgactgatgagcatcgcgaccaccaccagcagcatcgataacgccagcgaggtattggtaatattatgctcgttcataacgcgcctcctgcatctctccggcagatggcgttaacgttatcaccttatccgcgtgttgaatttcatctttatcatgcgttacccacaagacagcgacctgcttatcgcgaacatagcgatgaataatatcattcacattccgtttgttatgttcatccagcgcgctggttatttcgtcgagtaacagtattttcggcagaaactgtagattacgaattagagcaatacgctgtttttccccgccggaaagcgcggcaatcggtttttgcagaatcgtctccggcagttcaaaacgcgccagatcgtctgcgaaggctgtcggctgcgggcgctgatggcgaatttgccagggaaaaatcaggttatcgtaaaccgtatcgccgaatagcgctggcgtctgagcgcaataagaaacctgctggcgataggcttccggactcagagtagtaatatcccgcccctcaaaaagaatcacgccgatatcagggcttattagcgaggccaccattttcaacaacgtactttttccgcagccagaaggaccggtaattaacttaaattcgccgcgttgcagcgtaaaactgatgttattcactatttttgtcgtcgcagtctggtaaccgacctgctttaactcaagcaacatgctacgttttgtcatttattgcgcatccgttgttcatatttttatagcgatagtgtatccctgtaattaataaggggggaacatgctttactgaatcaggtataattcgcttaattcgtcagcaaaatcggtttatggacaacgcaacaggaggtttagctatgctcattcttatccctattctcattttcgtcgcgctggtgatcgtcggcgcgggcgtcaaaatcgttccgcagggataccagtggacggtggagcgctttggacgttacaccaaaactctgcagccgggattaagccttgttgtaccgtttatggacagaattggccgcaagatcaatatgatggagcaggtgctggatattccgtcgcaggaggtgatctcaaaagataacgccaacgtcactatcgatgcggtctgttttattcaggttatcgatgcgccgcgcgccgcttatgaagtcagtaacctggaactggcgatcattaacctgaccatgaccaatatccgtacggtgctcggttcgatggagctggatgaaatgctctcccagcgcgacagcatcaacgcgcggctgctgcatattgtcgatgaagccaccaatccgtggggaattaaagttacccgtatcgaaattcgcgatgtccgtccgcccgcggaattgatctcctcgatgaacgcccagatgaaagcggaacgtaccaaacgcgcctatatccttgaggccgaaggggtgcgtcaggcggaaatcctgaaagccgagggggaaaaacagtcgcagattctgaaagccgaaggcgaacgtcagtccgctttcctgcaggcggaagcgcgcgaacgttccgccgaagcggaagcccgcgctacgcagatggtgtctgaagccatcgccgccggggatattcaggcgttaaactacttcgtggcgcagaaatacaccgaagcgttacagcaaatcggctcggcgaataacagcaaagtggtcatgatgccgctggatgccagcagtctgatgggcgctatcgccgggatcagcgagctggttaaggacagcgccagcgaacggaaaaaagcatgatagcgatgattctggtacatccacatatcttctggcttagcctcggcggcctgttgttggctgcggaaatgctcggcggtaacggctatttgctgtggagcggcgtggcggcagtgattaccggcttaaccgtctggctcttaccgctcggctgggaatggcagggcgtgctgtttgcggccttaacgttgctggcggcctggctttggtggcgctggctggcgcgtcgcgtgcgggaacaaaagccgaccgacagccgccttaaccaacgcggacaacaactggtaggccgccggtttatgcttgatgccgcgttagtgaacggacggggtcatatgcgtgtcggtgacagctcgtggccggtatgcgctgacgaagacctgcgcgcaggtacgcatgtcgaagtgatcgccgtggaaggcatcaccctacgcattcgcgccgtttaatcaacgtaacttttgcgccttgtgatgacagcagccggaaagattatcaataatcgggcagtcggcgctgtcatcgccgggacaactctccgccatcgccaacagttgatcgcgcattgattgcagctcgctgatatggcgttcgatctccgcgaccttttccagcgtccgctttttcacatctgcgctatggcgtcgcggatcgttaaacagattgaccagttcgccacactcttccagattaaaccccacctgcctcgcctgtcgcagcaacgtcagctcgtttaaatgcttctgcgtgtaggtgcgataaccattttcgctacgtaatggcggcgtcaccagccctttctcttcataaaaccgaatggctttgctggttaaaccggtttttttcgccacatcgctaatattcatatttcccccttgaccttaaccttgctggaaggtttaacctttatcacagtgagtcactacgattactaatgtcaatgaattgatgaccaatcataaaggagtttttactatgtctcaaactatcgacctgaccctggacggtttgtcctgcggtcattgcgttaaacgcgtgaaagaaagtcttgaacaacgtccggatgttgagctggcggacgttaccgtaaccgaagcgcacgttaccggtaccgccagtgcggacgcgttaattgaaaccatcaaacaagccgggtatggcgcgacgttaagccacccaaaggctaaaccgctgacggagtcatcaatcccgtcggaagcactggcagcggttcctcatgagcttccggtagcgacggccgatgaagaaagccaacagttgctgttaagcggcatgagctgcgccagttgtgtcacccgcgtacaacatgcgctacaaagcgtaccgggcgtcacgcaggcacgggtaaacctggcggaacgcactgcgctggtgatgggcagcgcgtccgccgctgatttagtgcaggcggtggaaaaagccggctacggcgcagaggcgattgaagatgacatcaaacgccgcgagcgccagcaggaaaccgccatcgccaccatgaaacgttttcgctggcaggccatcgtcgccctggcggtcggtataccggtcatggtctgggggatgatcggcgataacatgatggtgaccggcgacaaccgcagcctgtggctggctattggcctgatcacgcttgcggtgatggtttttgcgggcggtcacttttaccgtaacgcgtggaaaagcctgctgaacggcacggcgacgatggatacgctggtggcgctcggcaccggggtcgcctggctctactccatgagcgtcaacctgtggccgcagtggttcccgatggaagcacggcacctctattacgaagccagcgcggtgattatcggtctgattaatctcggacacatgctggaagcgcgcgcccgtcagcgttcctcaaaagcgctggaaaaattactcgatctcaccccgcccaccgcacgcgtcgtaacagaagacggcgaaaaaagcgtcccgctggcggacgttcagccagggatgctgctgcggctcactaccggcgatcgcgtgccggtggatggcgaaattacccagggcgaagcgtggcttgatgaagccatgctgaccggcgaacctattccgcagcaaaaaggcgaaggcgacagcgttcatgccggcaccgtcgtccaggacggcagcatcctgttccgcgccagcgcggtgggcagtcataccacgctgtcacgcattattcgcatggtacgccaggcgcagagcagtaaaccggaaattggccaactggccgataaaatctccgcggtattcgttcccgtagtggtggccattgcgctgttcagcgccgctatctggtatttcttcgggccggcaccgcaaattgtttatacgctggtcatcgccaccaccgtactgattatcgcctgcccttgcgcattaggcctggcgacgccaatgtcgattatttccggcgtaggccgcgcggccgaattcggcgtgctggtacgcgacgccgatgccctgcaacgcgccagtacgttggataccctcgtttttgataaaaccgggacgctgacggaaggcaagccgcaagtggtggcggtaaaaacctttaacggcgttgatgaagctcaggcattacgtctggcagccgcgctcgaacaaggctccagccacccgctggcccatgcgattctggaaaaagccggcgatgataaactgccgcaggtgaacggtttcagaacgctgcgcggactgggcgtcagcggtgaagcggaaggtcatcaactgcttctggggaaccaggcgttactgaacgaacagcacgtcgccacggatgatatgacggcggaaatcaccgcgcaggcctcgcaaggctcgactccagtcctgctggcgattgacggtaaagcggcggcgttactggcggtacgcgatccattgcgcagcgatagtattgccgcacttgaacgcctgcacaatgccggataccgtctggtaatgctcaccggggataacccaacgacggctaacgcgattgccaaagaagcgggtattgatgaagtgattgcgggcgttctgccggatggcaaagccgatgcgattaaacgcctgcaaagccagggtcgtcaggttgcgatggtcggcgatggtatcaacgatgcgcccgcgctggcgcaggcggacgtcggtatcgcgatgggcggtggcagcgatgtggcgattgaaaccgcggcgattacgctgatgcgccatagtctgatgggcgtggcggatgcgctggccatttcgcgcgcgacgttgcgcaatatgaaacaaaacctgcttggcgcatttatctacaacagcattggtatcccggtggccgccggtattctgtggccgtttaccggtaccttgttaaacccggtagtagcgggcgcggcaatggcgctgtcttccattaccgtcgtcagcaatgccaaccggctattgcgctttaaaccgaaagcgtaaaaagtctatacccaaaataattcgagttgcttaaaggcggcaagggagtgagtccccaggagcatagataacgatgtgactggggtgagcgacaaatctgccgggagcagatttgaacgtcgcgtgcgacggcccgtcagggcgaggcccatggatgggccgagtaatccgtagccaacacataagcaacttgaagtatgaagggtatatatcaggcagcatcagctgcctgatatattattaagccatcagcaatttaccgtatcaatatataaaaatttaaccgcacatcctatagaaaaataaaaacaacattttataatgtttttttgaatcataaggatgtgttatttatgtttagaaaagcagttacgcttcttttcctgctttctcccgcagttagttatgcaggattatttgattccactccagagttaaaatgtggcaacgataatgcagtcacggcggcaaaagagtggatttacaatgaagcattaggtcgtttacagcaagactatattaaagagccctccacgcttttcttcgatatcccccagactcaatacgagcagcaactccgggctattcctgttcaattcagtgatgtaatcacgcagaaccctcaaccagaaaatgccaacctacgaacttgctcggctaccgtcgccatgagtattcctcagccattgtttaaattaatgaaagacttaccaaatactctattctatatttcacaaggggatggacaggtaataaacaatacggtgacctggaaacaggttaactacaatattcagctagcagacaacaataaagatattgttgtcacccctgtgcagaaaaccgataaattggcgcggtctatttatgtaatggcaagaatgacggtatctggtgatagcattataaagaaaaaaaataactcactgattgaaatcgcagcaaagaaatttgagagtagagatcgcgagcttaatcaggtctggaattcgctacccacctctgcccgaacggcattaaaacaagagcagcgagtctgggtgacaaaaaaagagcaacagtgcggcaaacttagcgatgcaaaatccgaggacatacctgctgaaaagcgcatcagtatttataaatgccagcttgaaatgaccatcgccagaacgacctatctcgacggcagcgaactacccgactgatcgttgacgtcccgtcagggcgcattgcgcccttttctccaacgcgctagcatgagctttttcaaagggagcgcgtatggagctattaaatcaacttaaacgtttatgccgcgcgctgcgtggtaccccaaatagttggcctgctatcgatctctccctgcccggcggtcgtcatctgcatctggttggcagtattcatatggggacgcgcgatatagctcctcttccagcaaagctggtgaaaaagctacgccaggccgacgcgctggtcgttgaagcggatatttccggtaacgaaacgccattcagcaatctccccaaatgcccgccgttggtcgaacgtctcagcgccgggctgctaaacacactggaaaaacgggtcagcgagttgggtatgccgctgatccattttgataatcaacctttatggcagatagctatggtgctacaggccacgcaggcgcaacggctgggattgcgcccggactatggcattgattatcagctattacaggctgcccgcgaaatgtcgctgccggtgcaagagctggaaggggcgaaacaccagctcgaactactatgcgatctgcccgatggcgggatggcgctgctcgacgacacgctgacgcactggcacaccaacgcacggcttttgcaggtgatgatcggctggtggcttgaacagccgccgaccagcatcggcgcttcgctccccagaacgtttagccaaccgctgtatgatgtactgatggtgaaacgcaatgaagcctggcgcgacgcgctgctggcactgccaccgggacgctacgtggtagccgtaggggcgctacatctgtacggcgaaggcaacctaccgcaaatattgaaataaaaaatggccaatatcgctattggcccgtcaaagaggaatttcatcgttattattatcccgacgctttcgcttcggatcttcagattgtcgctcaaagttgccgcaactgccaagacctaatgcacaagattatactattttttagtccgctttcgggcgtatgctgatggcaaatcacgtctgtagtaagaaggaacgttatgacacccgcagttaagttactcgaaaagaacaagattccgtttaacattcacacctacgatcacgatccgaatgaaactaactttggcgatgaagtggtgcgtaagctcgggctaaacgccgatcaggtgtataaaacgcttttggttgccgtgaatggcgatatgaagcaactggccgtcgccgtgacgcctgtagccgggcagctggatttgaaaaaagtcgccaaagctctgggcgcgaaaaaggtcgatatggccgacccgatggtggcgcaacgcaccacgggatacctggtcggcgggatcagtccgctgggacagaagaaacggctgcctacgctgattgacgcgccagcccgcacgtttgccactatttatgtttccggtggtaaacgcgggctggatattgaactggcggctgacgatttggccgccatcctgagtgctaaattcgctgatatcgcgcgtcgggattaagcctgcgtaaaatacattgccggatagcggcgcaaacgccttatccggcctacagcatacataatccgtaggccttaaggctgtgcgccatcaggcagagatggctatcagtaccgctacagccagttcacctcgccatttggcgtaaacgccgccgcatccaacggtgaattctgctgaataaactctttcagcacttccgcgtcaataaacccggtattcacgtagcccggtttgttatcgatgcgcggataaccatcgccgcccgtggcgttgaaactcagcgtcgccatgcggtaggttttggccggatcaacaggctcgcctttgattttcagatcggtgagcttgccctctttggcgacaaagctcacattggcgaactgtggataggcgccggagtccggtttcatctgcgctacggcggtgagataatcaaccacctctttgccgctcatatcggcatacaccacaatgttgccgaacggctgtaccttgagcacgcttttataggtaatatctcccgcctcaatcgagtcgcgaataccgccgccgctcatcacgccaaaatcggcaccggtgcgcgcgatctgcgcagccagaatcacccgtcccatattggtctggacaaatctgaccttactgcgatcgccttcaagcaggccattcacgctaccaattttcacctccagttgcgctttacctttattctggaacggcgttaataacgagagcatttgcggattttcggcgatttccggcgtgtaaagtacacgctcgcttttcccgttatcccaggtcacttttttcttgagatttaccggaataagctggtagttaaccattttcatctcgccgttacggaattcgaaatccgcgtggcccacatatttaccccactcatgcgcctgcacgctccagatgccattttgcttatccggcgcgcagggcgttcccgttacgtaattcacctgtttttattttccgacgccatgcataccgggtcttgtgagtgaccgcccacaatcatcgccagcgaaccggcaggcagactacgcgccatctcaacgtcgcccggcgcattcgaaccgtgatcgccgttgtcataatgtcccatatgcgtggtcgcgataatcacgtccggtttttcattcatattaagttcctgaatcaccacctttgcttcttcagcaggtttacgaaactcaatatcggtgaaatattccgggttgcctattttcgccgtgtcatcggtggttaagccgattaccgcgatttttatatcctggcgtgtaaaaatagcccacggcttaaacagacgctcgccggtacttttttgataaatattggcggaaagaaagggaaacttcgcccacttttcctgctggcgcaatacggtgagcggattatcaaattcatgattaccgacggccatagcgtcgtagccaatcagattcatcccgcggaaatcgggctccacatcctggagatcggattccggcactccggtattaatgtcgccgccggataacaacaggacgcttcccccctcttgcgccacctctttacggatactgtccaccagcgttttttgcgccgccagaccatattcgccatattcgctgcgccagaagtgaccgtggtgatcgttggtatgcaggatagtaattttataggttttatctttttcgtaagcctgtgcaggctgagtcgtcagcgcgaacgccgccagtaacgccagcgccacaccccgtttcaaaaatttcatctttctctccctgactcaatatcaaccgcagaaattacctttccttgcaataatagacaaatatgttttcagaattgagacttccttcaaacacatttcacaggtatgttaggcaagtaataattacacatcctactatctccaacatcgcataaaatttaagtgactttctatggccatgagtgaaccaacccagccgttagccggcgcgcccgcagcggccgctaaagcacgtacttcgtttggtattttgggcgcgatcagtctttcccatctgctgaacgatatgatccagtcgctaatcttagctatttatcccctgttgcaggcggagttttcgctgactttcgtccagataggtttgatcaccctgacgttccagctcgcctcatcgctactgcaaccggtcgtcggctactggacggataaatatcccatgccgtggtcgctgcctgtcggcatgtgttttaccctgagcgggctggtactgctggcaatggcgggaagttttggcggcgtattgctcgctgcggcgctggtgggtaccggctcgtccgtttttcacccggaatcgtcccgcgtggcgcgcatggcctccggcggacgtcatggtctggcgcagtctatcttccaggtcggcggtaacttcggcagttcattgggcccgctgctggccgccgtgattatcgcgccctatggcaaagggaatgtcgcctggtttgtgctggccacgctgctggcgatcgtggtgctggcgcagatcagccgctggtatgcagcccagcaccggatagcgaaaggcaagccaaaagcgataatcgctaacccgctgccgcgcaataaagtcgtgctggcggtcagcgtgttattgctactcattttctcgaaatatttctatatggcgagcatcagtagctactacaccttttatctgatgcaaaaattcggattatcaatacaaaacgcgcagctccatctgtttgccttcctgtttgcggtggctgccgggacggttatcggcgggccggtgggcgataaaatcggcagaaaatatgtgatttggggctctattctcggcgtcgcgccgtttacccttgttttaccctacgccacgctgtactggacggggattttaacggtgattatcggctttattctcgcgtcggcgttttccgccattctggtgtatgcccaagagctgctgccaggacgcatcggcatggtttccggcctgtttttcgggtttgccttcgggatgggaggcctgggcgcagcggtgctggggctgattgcagaccataccagtatctatttagtttataaaatctgtgcttttctgccgcttctggggatactgaccatattcttacctgataatcgacataaagcatgattttatggcggttaaaggtatgctttaaccgcctgtacatcctgatgccatcttgctttgtccatcccatgcttatcacttttacgttccatgctctttttgccttcagatcgtatctttttataaaacacaaccattttttataaacatcctgattgaaattgtcataaactattacccggagttttggagtccagcaaccaaaggagacggaatgcatcacgctaccccgcttatcgccaccattgtcggcggccttgtgctcgcttttattctcggcatgattgccaacaaattgcgtatttctccactggtgggatatctgttagcgggcgttctggcgggaccttttaccccaggttttgttgcggataccaaactggcgccggagctggcggagctcggcgtgattctattgatgttcggcgtcgggctgcatttttcgctgaaggatttgatggcggtaaagtctatcgccattcccggcgctgtcgctcagatagcggtggcgacgctgctgggtatggcgctttccgccgtgctgggatggtcattaatgaccggcatcgtttttgggctctgtctgtctaccgccagtaccgtcgtcctgctgcgcgcgcttgaggagcgacaactccttgatagccagcgcgggcaaatcgccatcggctggctgattgtcgaagatctggtgatggtgctgacgctggtcttgctgcccgccgttgccggcatggtggaaaaaggcgatgtcggcatagcctcgctggcagtcgatatggggataaccattggtaaagtggtggcgtttatcgccatcatgatgctggtcggacgccgcctggtgccgtggattatggcccgcagcgccgccaccggctcgcgcgagttatttaccctttccgtactggcgctggcgttaggcattgcgtttggcgcggtagaactgtttgacgtctcttttgcgctgggcgcgttcttcgctggaatggtgcttaatgagtcggaactgagtcaccgggcggcgcacgatacgttgccactgcgcgacgcctttgccgtcctgttttttgtttccgtcggcatgttgttcgatccgctagtcttgattcaacagccgctggcggtgttggcgacgcttgccattatcgtctttggtaaatcgatcgctgcgtttttcctggtgcgtatgttcggccactcgccgcgaaccgcgctgaccattgccgccagcctggcgcaaatcggtgagttcgcctttattctcgccggactcggtatggcgctcaatctgctgccgcaggcgggacagaacctggtgctggcaggcgctattttgtcgattatgcttaatcccgtactgtttaccctgctggagaagtatctggcgaaaaccgaaacgctggaagagcaaactctggaagaggctatcgaagaagagaagcaaattccggtggatatctgtaatcatgccctgctggtgggttttggccgcgtaggcagtctgctgggagaaaaattactggcggcggggattccgctggtggttatcgaaacgtcccgtacccgcgtggatgaactgcgcgaacgcgggattcgcgccgtactgggcaacgccgctaacgaagaaatcatgaatctggcgcatctggactgcgcccgctggctgttattgaccatccccaacggttacgaagccggtgagattgtcgcctcagcgcgagaaaaaagccctgatatcgagataatcgcccgcgcgcactatgatgatgaagtgaaatatattaccgagcggggagccaatcaggtagtgatgggcgagcgagaaattgcccgggcgatgctggaactgcttgaaacgccgcccgcgggtgaagtcgtcgccagttaagggtttgccggacggcccgatgcgcgcagcgccatcgggcaagccagattagcgatcccagtacgactcttccaggctgtcctcacgttccggcagcccgcgtgtcagacgcggagaatgctggttcagtacctgataactgacacggttagcatatttacacacctgcgccagcgacgaataggtcagccaggtgaatttgtgcttactggagttcggtacgttgctacgatggtaactgttcgccgtaatatcgtgcagcagcgccgccagcgcgccatcgcccgcgccgttggtgttcatgattttttccggcccgcccatatacggcgcaatatgcgaataaacgcgcagcggattagtacaatctttatggcgcattgcccggctaaattcatactggttaaattcagcaatagcccccggcagcagaggatgctgggttttacgttttgcttcctcttcggtgaagcctgccatatataaccctatcggcccggcggtgcataacaccaggtcgacccagtccagcgccttatccgccgccagcagcgggtcgttttcgccggtcagcgcttccgcttcttcttcattcattgccagaatcgagacattctctttgagaaacgcctgccaccactgcggattatcggcgatcacaaatttggtgcccagcgtcatgacaaccggcacgttatgctttttcgcgtattcgatcgctttcatcgtcgcgtcaggcatcggttcgccaggcttacagcgcaccagatatgaggtcaacaccagcgcggaagcgccagcgatcaccgcttccggaatactttccgcccgtagctgattcatatggccggggctgatagcgaaggtacgctcgccggattcgccaatcagcgtgaaacagcggccaatcggaccatctaccgcttgcagataattcaggtcggtacggctggaagtattacacaggtagcgataagcgtagctgccaatctcaatgttgctgcacatcacgcccagtaacaccgaacggtcatccgccagtaccgagtaattatgcatcgtattgcctatggtgccgccagcaaactgatgggtgatcagattttcccgcgtcagttcctgatacagcttctccgccaactcgtcttctatcaccagagaatgcccggcgcttaatccatagcgtgtaataaaatcgtcatccactttcgcctcaatatccaccaacgtctggtcgataccgacgacccaggaggcgttggtttcctgttctggctgaatttgttgcaacaacgggtcacgcgcattgacgggaaaatagtgtttggatttacgtttaccgggaaatttcatgattgtgcttacggatgaataacggagcgctgcatggtagcacattccccctgctgcgcgcgacggacgatggcgtttcaatatcggacgacgagatcgcagtttctccagccgcgttttttacaatggttcactttcacaaggagcgttttatgaagccggaaaataaaattcccgtactcacccgactgtctgacgaaatgacagccgtcgtaaacttccagcaaccaggccttcccccctggcctgccgatggcgatattgagacccagcgtcagtattatcttcttgagcgccgtttctggaatgccgacgcgccgtccatgaccacccgcacctgcgccgtctctacgccttatggcgatgtaacaacccggctctactcgccgcagccgaccagtcaggccaccttatactatctgcacggcggcggatttatcctcggtaatctggatacgcatgaccggataatgcgtctgctggcgcgttataccggctgcaccgtgatcggtattgattattcgctgtcgccgcaagcgcgttatccgcaggccattgaagaaaccgtcgcggtatgcagctacttctctcaacatgccgatgaatactcgctcaacgtggaggaaatcggtttcgccggagattccgcaggcgccatgctggcgcttgccagcgcgctctggctacgtgataagcacattcgctgcggtaacgttatcgcgattctgttgtggtatgggctgtatgggttgcaagattcggtaagccgccgtctgttcggcggcgcgtgggacggcctgacgcgtgaagatctggacatgtacgaaaaggcctatctgcgtaacgatgaagatcgggaatcgccctggtattgtctgtttaataacgatctcacgcgcgatgtgccgccctgctttattgccagcgcggagtttgatccgctcattgatgacagccgcttgctgcaccagacattacaggcgcaccagcagccctgcgaatacaaaatgtatcccggcacgctgcacgccttcctgcactattcgcgaatgatgacaatcgccgacgatgccttgcaggacggcgcacgcttctttatggcgaggatgaagacgccgcgttaacggtacggcgccgtgagtttcagtatcatatcaatatgttccggcgtcgcgttcagcgcctgaatgtacgcatattttttaccgcccgcttcaaggaaaatctcgcggttctgttccgctatctcttccagcgtctccagacaatccgcggcaaaccccggacacatgacctgaatatggccagtccccttttcacccaacatttttagcgtttcatcggtgtacggcgtcagccacggttcacggccaaagcgcgactggaacgtcatcattaccttttccggcggcagtcccaatgcggaaaccagttcacgcgtggtatcgcgacagcgctgcgggtagtcatcgccttcatccgcataacgttgtggaatgccgtgataggagagcagaagtaaatccggctcgccgtgtctggcgaacgactcacgcgcgcttttcgccagcgcatcgatataagcgccgtcatccgcgtaatcgcgaataaatgagatcccgggaatacgacgtttacgcgccagtatccgccccagttcgtcccagactgcgcccaccgttgagcaagaatattgcgggtacaacggcagcacgacgatatggtcgacgtcgcttgctaacagttcatcgacagcgctttccagcgagggcgagccgtagctcatccccagcgcgacgggcgtgtctggcaaccgcgcggccagcgcctgttgctgttcgcggctatataccatgagcggcgaaccgccatccatccagatagattgatagagtttcgcgacgcgcggcgaacgcagcggtaaaataacgccacgcagcagcggccaccacagcagacgaggagtatccaccacgcgtctgtcgcttaaaaattgtttcaggtagcgctttaccgcttcaggagttggggcatctggcgtgccaaggttagccagcaggataccggttttcgtctgacgcattgccgcctcttatctattcaaattgttgataattgtagcggaaaagcgataaagaagaactaattgctgcgagaggtaagacgagaatttgccgaatggcgctaacgataccggtaggccggataaggcgttcaggccgccattcggcaccgattgcctgatggcgctacgcttatcaggcctgcgggataatggcaggcctgataagcggttcactacgcgaaaaaaattaaccgaggattttttccagcgctgcgcgcacgtcggcaacggcctgcgtaccgtcaactttagcgtatttggtgttgcccgcttccgcttctttctggtagtagccaatcagcggcgcggtcatctgatgatattccaccagacgtttgcgaacggtctcttcctgatcgtctttacgggtcgtcagatcttcgccggtgacgtcatctttgccttccactttcggcggattaaacttaacgtggtaaacgcggccagaggcggcgtgtacgcgacgacccacaatacggtcaacgatcagttcgtccggtacgtcgaattccagcacgtaatccaccacaatacccgcttctttcatcgcgtcagcctgcgggatcgtgcgcgggaaaccgtccagcagaaaaccgttacggcagtcttcctgggcgatacgctctttaaccagcgcaatcaccagttcatcggtcaccagtttaccggcgtccatgatatctttcgcctgtttgcccaactcggagcctgatttcactgcggcgcgcagcatatcgccagtggagatttgcggaataccatatttctccatgatgaactgagcctgagttcctttacccgcgcccggagcgccaagcagaataatacgcattacgaaaatcccctcaaaggttgtcgatattttttaaaaagcgctaaacgataccaccatcacgcatttcgctcaaggaagtcgcctgatgctgaaacggttaacgaagagaaatccagaaaagagaaggtattataaaaaatgccggatggcgctgacgcttatccggcctacaaacagtactcgtccgtaggccggataagatgcttcgcgtcgccatccggcagtcacaaaacagtactcgcccgtaggccggataagacgcttcgcgtcgccatccggcagtcacaaaacagtacccgtccgtaggccggataagatgcttcgcgtcgccatccggcagtcacaaaacagtacccgcccgtaggtcgggtaagacgcttcgcgtcgctatccggcaatcagatgagcgttatcaggacaccagcaactggttcatacggcggataaactggttcggatcttccagcgtaccgcgttcagcgaacagcgcctgatccagcagcagctcgacccactctttaaactgcgcttcatccttggtatcggcagtgcgtttgaccagcacatgatccgggttgagctcaaagatgtatttcacttccggcacggactgaccggccgcggcgaacagtttcgccatctgggtgctcatttcatccgcatcggtggtgacaatcgccggcgtgtcggttaaacggtgtgtcagacgcacctctttcacgcgatcgcccagcagggttttgacacgctccacgaacggctcaagcgccttttccgcttctttcgcgttttcgtcgacttcatccgccagtttttcgatggactcatcggctttagcgaccgactggaatgctttaccgtcaaactcggtcaggtagttcatcatccactcgtcgatgcgatcggagagcagcagcacttcgatgcctttcttacgcagcagctccaggtgcgggctgtttttcgccgccgcatagctgtctgcggtgatgtagtagattttttcctgcccttctttcatccgggagacgtaatcttccagcgacacggtctgggcggaagagtcggtatgggtggaggcaaagcgcaacagtttagcgatcgcttcctggttggcgtgatcttccgccgggccttctttcaacaccagaccgaactgtttccagaaggtttggtatttttccgcgtcgtctttcgccagtttttccagcatttgcagaacgcgtttggtcagggcgctgcgcagattacgcgttaccgtgctgtcctgcaggatttcacgggagacattcaacggcaggtcattagaatcaatcaggccgcgcacgaaacgcagatagttcggcatgaactgctcggcatcgtccataatgaacacacgctgtacgtacagcttcagaccatgtttgtgatcgcggttccacagatcccacggcgcctgcgacgggatatacagcaggctggtgtactcctgcttaccttccacgcggttgtggctccaggtcagcggatcggtgaaatcatgcgcgatgtgcttgtaaaactcgttgtactcgtcgtctttaatttccgacttgttacgggtccacaacgcctgggccttgttgattttctcccaggaaatcacggtttcgccgtctttttcttcccgtttttcaatctctaccggcaatgcgatgtgatcggaatatttactgataattgagcgtacgcgccagtcatcgaggaattcatcttcgccttcacgcaggtgtaaggtgatttccgtaccacggtcatttttggtgatatcggcaacggtatattcgccttcgcctgccgattcccagaacacgccattttccggcttgtcgcctgccgcacgggtacgtacggtcactttatcggccacaataaacgcggagtagaagcctacgccaaactgaccgatgagctggctatctttcgcctgatcggaccccattgattcgaggaaagatttggtgccggacttggcaatggtgcctaagtggtcaatcacctcatcacgattcatccccacgccgttatcggcaatggtcaacgtacgcttatctttatcgaaagagacgcgcacacgcagctcgccatctccttcatacaggtccgggtttgacagagcgcggaaacgcagcttgtccgccgcatctgaggcgttagagatgagttcacgcaggaagatttctttattggaataaagagaatggatcatcaggtgcagaagctgtttaacttctgactgaaaaccacgcgtttcttgtcctttcatgtggatagacctcaacaatgccatttttaatggtaaaaatacgttgagggtgagatggggacaagcgggtgtgatttcaagcggaggccgcgaacgccgcctccgtttgttcagaaaataatcttatggcgtcccgccagcgagtgggacagcgtcgtaccgtcgaccatctccagttcgccgccaaccggcacgccgtgggcgatacgactggcttcgacgccggcctccgcgcacagctcggcaatatagttcgcggtagcctccccttcaaccgtcgggttggtcgcgaggatcagctcgctgattttttctgacgccagccgctgttccagacgatcgagaccgatatcatccggcccgatgccgtccagcggcgacaggtggcccatcagcacgaaataccgcccggaaaattgcccggtctgctcaatggcgtagatatccgcaggactctccaccacgcaaatctggccgttttcctggcgccgcgggttcgaacagatattacaaacatcctgctcggtaaaggtgcggcagtcggcgcagtggccgatttccgacatcgcccgggtcagcgcctgcgccaggcgcattccgccgctacgatcgcgctgcaacagggtaaacgccatccgttgcgccgacttagggccgacgcccggaaggcagcgcaacgcttccataagctgagttaacagcggactggtttgcatcagaatggcatcttaaagcctggcggcagttgcataccggaagagacggaagccatcttctctttttgcgtctcttcaatgcggcgcgccgcatcgttgaaggccgcagcgaccagatcttccagcatctctttgtcatcttccagcaggcttgggtcaatttccacacggcggcagttatgcgcaccgttgatggtaaccttcaccagacccgcgccggattcgccggtcacttccagctgcgcaatctcttcctgcattttctgcattttttcctgcatctgctgggcctgcttcatcagattgcccagaccgccttttccaaacataagctctctctcttgatggttcacaatcgcaagccgggcttacgatcaaatggggcggatactctcttcatccagctcggcgtcgaagaatcgacgcagcgtctgaatgttattatccgcgataattgactcacgcgcttgcgcgagtttctcttcataaatggcctgacgccattccagcggcgtacgcaccgcgggattatcatcttcaacgatggtcagttcaaccgtcgttcccgtcagatcgctgagcgcttgcgccagcttttgctgcgcaccgctggaattgaggtgccgctgcgtcgagcgcagatgcagacaaaccgcgttgccgttctgctccttccaggcattgagcgccacctgctccaccagcttaggcaaagaaagctggcttacctgcgccgcccacggatcgcgctcaatcgcttccgccgccagtttagccgccagctccggcgttttttcatgctccagagctttcttaagcgcttttggcgtagccaccacttctttggtttgcactaccggcgtggtggccttccagcgataagcctctttctttactggcgtcgtttccagcgcagacggcgccgggcgcgcctgtacgcgctccgaaaccgaggccagccgctccagcgcagagttattcaccggccgcgcgcgggatgcggctgccggttcactcttttttgttttggttactccctgcgcgcgctgtagctgattgcgcgccgccagcacctgactggtagacgccggcagcggcgctggcgatgtctgcggcgcgggcgccgacggctgctgcacctgcggcggcgtcattaccgccgttggggccacgggcgcaaaagactgccgcggcgtttcaggctccggcaagggcatacgcgggtgaaacgccagcgcacgcaataacgtcatttcaacgcccatccgccggtccggcgcccagggcaattctttgcgaccaatcaacaacgtctgataatagagctgaagatcgccgggaggcaccgtccgggcaagttcgcgcatccgttgctcgatagccgccatatcgctgcctaacgcggcaggcgaaagttgcaccatcgcaatacggtgcagcaggctaagcatttcgaccagcagcgcttcccattcaataccgcgcgccgccgcctcgttgataagcgacatgacgcgttcgccgttagcgtcaaccactgcctcgactaatgacaaagcctggtcgtcgtccagcgtaccgagcatggcgcttaccgcctgcgtcgaaacctgcccgtcgccactggcgatcgcctggtcagtcagacttaatgcatcgcgcaggctgccgtcagccgcgcgtgataacaactgcaacgcgcggggttcgtgagcgatatgttcctcattgagaatatgctcaagctgatggcgaatctgttcaacatccagcgctttgagatgaaactgtaggcagcgcgacaaaatggtcaccggcagcttctgcggatcggtggtcgccagtaaaaatttcacatgcgctggcggctcttcaagcgttttaagtagcgcattaaagctgtggcgcgacagcatgtggacttcatcgatcagatagactttaaagcgaccgcgcgcaggcgcgtactggacgttatccagcaggtcgcgggtgtcttcgactttggtacgcgatgcggcgtcaatctcaatgagatcgacaaaacgcccttgctcaatttcccgacagttatcgcaaacgccgcacggcgtcgcggtaataccggtttcgcagttcagccccttcgccagcagtcgggcgatagaagttttaccgacgccgcgcgtgccggaaaaaagatatgcgtgatgaatgcgccctaacgacaagccgttcgccagtgcggtcagcacatgttcctggccgacgacgtcagcaaaggtttgtgggcgccattttctggctaagacctgataactcattggcaggctctgaaacgctggaaggtggattcatagaagggtaatgctaacacaacctcgccgatacagcgaggttgtctctctggctaaaatagcagtgcgaatagcctgaatcaatgccctggaaacggcatcaggctataacaggtaatcccctgcttttccagacgctgctcgccgcccagatcgaacaaattgatgatgaacgccgcatcggtgactttcccgcccagacgacggatcagcttcacggtcgcctcaatggtgccgccagtcgccagcagatcgtccacgaccagcacgttgtcgccaggtttaatcgcgtcgacatggatttccagctgatcggtgccgtactctaattcataggtctcggcaatagtttcacgcggtaatttgcgcggtttacgtaccggaacaaaaccaacgcccagcccaagcgcaaccggcgcgccaaacaggaagccacgcgcttcggtgccgaccactttggtgatacccgcatttttataacgctcaactaacagttcaatactgagcgcgtaggctttcgggtcttccagtaagctggtgacatcacggaaaagaatgcccggtttcgggtaatcctgaatgcttttgatgctgtttttgagaaactcaagctgctgtgcagtcgcggtcatggatatatgcctgctaagtacggtgttactcacggcgcaatacttttcagtcaggggtaacgctcggttactctttgaccgcctgcgcctgtgctcgaaaacggtcgaatttactggctgtgaacgacaattgcaacagcgattcgtgtgcttcagcgcttttgttgcttttcatcaatcaccggtatccgccacataaaaatcagcaggcaggccaaaataaccaacagcagcacccgcacccacatcatattcaccagccacagcgaaataccaaaggtcagcaatatcaacgcgatcgctcgcggtttcgctcccggcggcatggcccgatagcgctgccagtggcgcagataaccgccaaaccatgagcggtataacaaccaagcatggaaacgcggcgacgagcgggcgaaacaccaggctgccagtaaaatgaacggcgtagtcggcaacaggggcaaaaccacgcccagtgtccctaatactaccgccagccagccaatgatgattaaaatagtacgttgcataatgcgaatcgttatcaaacagaaggctactgtagcacagcctgtcttattttcatcggggtgttgaattgaaaaccgctatgctgttacagacgctggaagagaagctggcgacgctacgccaacgctgcgcgccgctggcgtaacatgcgacgttaagcgcgcgctttgaccgacaccttttccgtacccgcagtactctgttgcagggatatctggaagaggcagacgccaatctcgccgcgttgcgtcaggcggtaaaacatgagcaactgccgcaagtcgcctggctggcggaacatctggcttcgcaactggaggcgatatcgcgtgaaaccgccgcctggtcgctgcgccagtgggatgccgccgcaccagggcttggccgttggcagcgcagacgaatacagcatcaggagtttgaatgtcgactgctggcgatgacacaggagcgcaaaattcgtctggcgcaggcgaccggccttgtcgaacaacaaacgctgcaaaaggaagtcgagatctatgaaggacggctggcgcgctgccgacatgcgctggagaaaatagaaaacgtactggcgcgtttaccccgttaacccaggagaaagtatgtcgcttgaaaatgcccctgatgaagtcaaactggccgtggatttaattgtgctgcttgaagagaatcgcttaccggcacgaacggtgctacgcgcgctggaaatagttatgcgtgattatgaaaacaagttaaaaagtacggaagacgactcgcaaacagagtaatagccccctggtttgtcctcgttgtcgctgacaaagtggtcgctacagtcaggcaacaaaggacggggcatggaacgtctacccaccacgccgcacgatgcggtattccgacagatgctgatgcaaaaagaggtcgcccgcgactttctggctatccacttgccagaagactttcttgcaatctgcgatctggattcactgaagctggagtcggggagttttgttgaagacaatttacgcagccgctattcagatattctctactctctgcatacccaacacggccccgggtatgtttacgcgcttattgaacatcagagcaaatcagaccggctgatggcttttcgcctgatgcggtacgccattgccgccatgcagcgtcatctggatgccggccatgataccttgccgctggtggtaccaatcctcttttatcacggtccggaaagcccgtggccctatagccttaactggcataatatgtttgtgaaaccggatatggcgaaagccttatacagtcatgaatttgcgctggtcgacctaacgataatgccggataatcagcttttgcagcatcggcggatagcgatgttagagctcctgcaaaaacatattcgtcaacgcgatttaagcgaactgctcgacccccttatcacgcttttaacgcaggatcatttgacggacgcgcagctcagtgtgctgatcaactatatgttgaaagcaggaaacgccgcagaacccggggcgctaattcgtcaactggcgcagggcgcgccgcagtataaggaacaactgatgacaatagcggaatggctggaagaaaaaggccgaacggaagggttgcgaaaagggcttgagcaagggttggcacaaggccgtgaggccgaagcgcgcgctattgcccgcaaaatgcttgccaacgggctggaacccgggctcatcgccagcgtcaccggcattacgccggaagagctttctacgctttcgcattagcggcgccgcgcgcactcataaagcgcgcggcccaccgccttttagcttgccgccggcgccagatcgccgccgttgagatcgcgcttcacttcagtgacttcgtcgcccttcgcgttatgcagatgcacctcaagctggttaaaggcaatattgatatcattttcacggcacagtcgatcgatcgcgcggttcagttcatccaccgtatggctacgatcacgcaattcacgcacatacagacgcagttcatgatccagagtgctggcgccaaaggtggtgaagaatacggcaggttccggatcgtgcatcaccttcggatgctccatcgccgcctgtagcaggactcttttcactttctccagatccgagccataggccacgccaagccggatcaccagacgtgtcgtggtatcggagagggaccagttaatcagccgctccgttacgaacgctttgttcggaatgatcacttctttacgatcaaaatcggtaatagtggtggcgcgaatacgaatcttactgaccgtgccggagtaggtgccgatcgttaccgtatcgccaatgcgtaccggacgttcgaagaggatgattaaacccgagacaaagttaccgaagatctcctgtagcccaaaaccgagacctaccgacaacgccgccgccagccactggagtttatcccacgagacgccgagcgatccgaatactgtcatcgcgccaacagcgataatgacgtagttaaggatcgtggtgatcgcatacgaagccccttggcgcatattcaggcgtgaaagcaccagcacttccagcaggccgggtaagttgcggatgagcgcccaggccaccatcgcggcaataatggcaaatagcaagctgcccatcgtcacgcttttcaccaccgcagcgccagcttcggagccgttgtagtgccacagcgtgatgctatcaagatagctgaatacggtgatcaaatcggaccaaatcgcccagaacataacgccaaacagggcaagcattagcagcatcgtgatacgtaatgtttgctggttaatttgctccaacgcgatggtgggttcttcctgtggttccgccccttccgctccctcttttaccaggttctgacgacgagccagcgcgcgtcgccaggcaatccggcgcgccgctacacttaacccgcgcagcaccgtttgataaagcaggttccagataatgaccagatagacggtttcaatccagcgccccgccaggcgcagggtggtatagaaatagccagtcgccgttaataccattaacgccactggaataatggaaagaatcgtcacggtcaccagtcgaatgccgtgagattctttatcgcgccagctttcccggcacagtggccacaccagcaatgttatgaccagcagattgaggaaaataaccgcctgccccagcacgtcatccatcagattcagcggcgacaactccgccaccacagaccaaaagtgcagcggcagcaatgcgaggctaatgcgtacaatctggcgacgccagtggctggtcaactgcgccggcataccaaaatggcgtatcgccacgccttctttttccagcaccttccagcacagcccaaagaccagccagaacatcgcgagctttttactaaaggcccagagcagatcgctgatatttagctgcatggtcagcaggatcaatccaatcgcgaggataatcaggcacaccggcagcgcgcggatcagatcgatcagaatagcttttggcgtattgagctgactatcgttacgcagcgatcccacggcggcggccagcttctgttgatacgcttttaaccatttcagacgccagcggattaaaccggcgatgagcaagagcggcaacccggccaaaaaagcaataaatactgcgggccaggctttttgccagttcaccgtgattttcatggcgctgaattgctcttttaacgtttgggggaacgctttaagccagtcccagtccatagggcggttactgttcacccaaaaaatctgctgcgtcagaatggctttcagatttttcgagacgctcatcaactgctgctggttaacttgcaggttaatcgccatcatcagctggttacccaactgtttatttagctgatccaatagctcacggcgcatctccaccacctgaagcaacgcatcatgaacttcatcattcacctcgctggtatgcccctcctccagcttgtcgacaaaggcatcgctttggaataaggcatcacgctgctggttgatttcaaactgctccagacgcaaatccgcaatgcggttggtcatatcttcgagttcgtcggcggagggcagggtttgctgctgttgataaagaatacgcgacagcaacaggctgccttttaagacggcaatctgttctttgatatttctttccgactgcagagcgcgatcgagccagttttttactttaatgttttgctgcatcaacatattgccgttttcggtcgcgacaatcagacgctggctgagttgatggttaatatccagttcctgttttaccaacgggttcgcctggatacgcgccgtttcgtccggcgaaatagcctcctgggccgttttttccgttagcgtaagtcgtttactgttgaccgcctcctgtaaaagttgaagctgatgttcaaggcgattactgttggccgtcacgtaatcccgctgtttttgcagggtgtcctgcaaaacggtattcccttcaagactcttacgttgctggtcgatctgcgcattaagcagcgcctgttgtgcctgtaataacacctgttggctggggcgaagcgcggcttcgccgacgttattgccgtccagacggttacggatttgctgtatttgctgtgaggcggtatacatggcgttttgcacgcgctccggctgggtttgtagcgaaacaagctggctgttataagcggcaagatcgttttgcgagttttgcaaatcatccagtacctgcgccacgcgcagctcaagctgacgtagcgaaagcgcactcagcgtttttcgcatttcatcatcattatcgacatcgctcagcgcattcaacgcagccgtcgcctgacgcattttttcaggcgcctgcgccaccttctgccgtagctgtacggtctcctcttttacccgctcgattttctccagcgtagctaacgtatcaataaggtcttgctggacgagcttatcctgggcggagagatctttttgcttattcagcgtatccagctggttttgcacatccgcttttgacggcaggtcgccattcgtttgcccccgggcaaacgccagagactgacaggacagcaggataataagaacgctaattgtaataaaaacaaaatgctgtgaacgtttataaagctgcaacatagtcatgagaatgaagtgtctgaaccggcaagcagaccggaaataattgagtcgcaagaatatcacgcctgtaacaaacagaatagcgacacagaaaatgtccaggagttttcctggaatattatcagggggagccgttgaccgtcgacgcgcgcagcgtcggacacaattgatacatctccagcaggatcgtgacgtaggcgcgagcttctttttttaaatcaaacgattgcggagcaaataaccagttttccatgagccctgaaataaagctgcgcatcagtatcgccgcacgacgggtcagcagattttcaggcagcattttagcattaatacaatgttttaacgtttgttcaatccgatcgtaactttccagacaaaggctacgttgcgcctgttgaaccacaaccatttctccgacaaactcacatttatggaatataatctccatcaataagcggcgtcgttcttctgttacagtagcttcaagaatatgaactaaaatttctcttaatacagatagtggatcgtcggggaattttgcctgatactcaatctcaagctcaccaatattggattctgatagctcccagatctcactgaataaatccgacttatttttgaaatgccaatagattgcgccgcgcgtcacgccagcagcgttcgcaatctccgccagcgaggttgccgatacgccttgctgcgagaacaaacgcagggccacatccaggatgtgttgtcgtgtctccagcgcttgttgtttggtttttcgtgccatatgtcggtgaatttacaggcgttagatttacatacatttatggatgtatgtaccatagcatgacgataatataaacgcagcaatgggtttaaggacctttgaccattgaccaatttgaaatcggacactcgaggtttacatatgaacaaaaacagagggttaacgcctctggcggtcgttctgatgctctcaggcagcttagcgctaacaggatgtgacgacaaacaggaccagcaaggcggccagcagatgccagaagttggggttgtcacactaaaaacggaaccactgcaaatcacaactgaacttccgggtcgtaccgttgcttaccgtatcgccgaagttcgcccgcaggtaagcggcattatcctgaagcgtaatttcgttgagggaagtgatatcgaagcgggagtctctctctatcagattgatcctgcgacttaccaggcgacttacgacagcgctaagggcgatctggcaaaagcgcaggccgccgcgaatatcgctgaactgacggtgaagcgttatcaaaagctgctgggtacgcagtacatcagtaagcaggaatacgatcaggcgctggctgacgcgcaacaagcgactgccgccgttgtcgcagcaaaagccgccgttgaaaccgcacgtatcaacctggcgtataccaaagtcacctcaccgattagcggtcgtattggtaagtcgtccgtaacggaaggcgcgctggtacagaacggtcaggcgtcggcgctggcgacagtgcagcagctggaccctatttatgtcgatgtgacccagtccagcaatgacttcctgcgcctgaagcaggagctggcaaatggttcgctgaagcaggaaaacggcaaagcgaaggtcgatctggtgacaagcgacggtatcaaattcccgcagtccggtacgcttgaattctccgacgtgaccgttgaccaaagcaccgggtctattactttgcgcgccatcttccctaacccggatcacaccttattgccaggaatgttcgttcgcgcacgtctgcaggaagggacaaaaccgacggcattactggttccacaacagggcgttacccgtactccacgcggcgatgccacggtgctggtggttggcgctgataacaaagtggaaacccgccaaatcgtcgcaagccaggcgatcggcgataagtggctggtgactgacgggttgaaagcgggcgaccgcgtagtcgtcagcgggctgcaaaaagtacgtcctggcgcacaggttaaagtgcaggaaattaccgcggataacaaacagcaagccgcaagcggtgatcaacctgctcagcccaggtcttaacttaaacaggagccgttaagacatgcctaatttctttatcgatcgccctatatttgcgtgggtgatcgccatcatcatcatgttggcaggggggctcgcgatcctcaaattgccggtagcgcaatatccgacgattgcgccaccagcagtgacgatctccgcaacctaccctggcgctgatgcgaaaacggtacaggataccgtcacgcaggttatcgaacagaatatgaacggtatcgataacctgatgtatatgtcctccaacagtgactccacggggaccgtacagatcacgctgacctttgaatccggcaccgatgcggatatcgcgcaggttcaggttcagaacaagttgcaactggcaatgccgttacttccccaggaagtacagcaacagggcgtgagcgttgagaagtcctcaagtagcttcctgatggtagtgggcgtcattaacaccgacggcaccatgacccaggaggatatttcggattacgttgccgccaatatgaaagatccgatcagccgtacctctggggtgggcgacgtccagctgtttggttcgcagtatgcgatgcgtatctggatgaatccgacagagctgaccaaataccaactgacgccggtcgacgtgattaacgcgatcaaagcgcagaacgcccaggtcgcggcaggtcagctcggtggtacaccgccggtaaaaggccagcagcttaacgcatcgattattgcccaaacgcgtctgacctcaacggatgagtttggcaaaatcctgctgaaagtgaatcaggatggctctcaggttcgtctgcgggatgtagcgaaaattgagcttggcggcgaaaactacgacgtcatcgcgaaatttaacggtcagccagcgtcaggtcttggcatcaaactggctaccggcgccaacgcgctggataccgctaccgctattcgcgccgaactgaaaaaaatggaaccgttcttcccgccagggatgaaaatcgtctacccgtatgacaccacgccgttcgtgaagatctctattcatgaagtggtaaaaacgctggtcgaagcgattatcctcgtgttcttggtgatgtacctgttcctgcagaacttccgcgcgacgttgattccgactattgcggttccggtggtgttgttgggaacctttgccgtgcttgcggcattcggtttctcgataaacacgctgacgatgttcgggatggtgctcgccatcggcttgctggtggatgacgccatcgtggtggtcgagaacgtcgaacgtgttatgacggaagaaggccttccgccgaaggaagcgacgcgcaaatccatgggccagattcagggcgcattggtgggtatcgcgatggtactgtcggcggtatttattccgatggccttctttggcggctcaaccggggcaatttatcgtcagttctctatcaccatcgtatcggcgatggcgctgtcggtgctggtcgcgctgatcctgacgcccgcgctgtgcgcgacgatgctcaaacccgtcgccaaaggcgatcatggcgaagggaaaaaaggctttttcggctggtttaaccgcctgtttgataagagcacgcatcactacaccgatagcgtagggaatattctgcgcagcaccgggcgttatctgctgctctatctcattatcgtcgtcggtatggcttatctgttcgttcgtctgccaagctctttcttgccggatgaagaccagggcgtattcctgacaatggtccagctccccgccggcgcgacgcaagagcgcacgcaaaaagtgctggatgaggtcacggattactatctgaacaaagagaaagccaacgttgaatcggtattcgccgtcaacggcttcggttttgcagggcgcggtcagaataccggtattgcatttgtgtcgttgaaagactgggccgatcgtccaggcgaaaaaaacaaggttgaagcgattacccagcgggcaaccgcagcgttttcacaaattaaagatgcgatggtcttcgcctttaacctaccggcgattgttgaactgggcaccgcaaccgggtttgacttcgagttgattgaccaggcgggacttggtcacgaaaaactcacccaggcacgtaatcagttgttcggcgaggtggcgaaatatcctgatctgttggtcggcgttcgacctaacggtctggaagatacgccgcagtttaaaatcgatatcgaccaggaaaaagctcaggcgctgggcgtgtctattagcgacattaataccacgctgggcgcagcatggggcggcagctatgtaaacgactttatcgatcgcggtcgtgtgaagaaagtttacgtgatgtccgaagcgaaataccgcatgttgccggatgatattaacgactggtacgttcgtggtagcgatggtcagatggtgccgttctccgcattctcctcttcccgctgggaatatggttcgccgcgtctggaacgctataacggtctgccttcgatggaaattctgggtcaggcggcgccaggcaagagtactggtgaagcgatggcgatgatggaagaactggccagcaagctgccgtcaggcattgggtatgactggaccgggatgtcctaccaggagcggttgtccggcaaccaggcccctgccctgtatgctatctcgctaatcgtcgtcttcctgtgtctggcggcattgtatgagagctggtctatcccgttctccgtaatgctggttgttccgcttggggttatcggcgcgctgctggccgcgaccttccgcggactgactaacgacgtttacttccaggtgggcctgctcacaaccattgggttgtcggcgaagaacgcgatacttatcgtcgaattcgccaaagacttaatggataaagaagggaaaggtctggtagaagcgatgctggaggccgtccggatgcgtttgcgtccgattctgatgacctcgttagcgttcatgctgggggttatgccgctggttatcagttccggcgcgggttccggcgcgcagaatgcggtaggtactggcgtactgggcgggatggtaacggcaaccgtactggctattttcttcgtaccagtcttcttcgtggtggtacgccgccgctttagccgtaaaagcgaagatattgagcatagtcattcgacagaacatcgctgatttgctcactgttgataaggccgcgcaagcggccttttttacgcaaaaatcataaaatacgcttattgttagattgattattttttgccatattaataaaaggtataatccttactgcgttaaaggcttttcttaggaaagttggccatttcttaattcagccattaattaagaaatattaagaatattcctagctattttctcctgtcagagtctattgttttagcctgaaaagctaaaaaacgttaacccaatgattatacgagcaataaaactggttcctttttaggcgaccgacgttcactgttaaaattcgaaaaagtatggcgacacacggctttcacgcaattgtaatttttagtaatatgacgatgaaaagttttttagagtagattatagttaaatcataaggtgacgtgggaagtaccaggttagttagttgtatccatcccgaaggtgttcggttagtttaagccactaaaaaggggatgcattatggacgaatactcacccaaaagacatgatatagcacagcttaaatttctttgcgaaaccctgtatcatgactgtcttgcaaaccttgaagaaagcaaccatggctgggttaatgacccgacctcagcagtcaacctgcagctcaatgagctgatagagcatattgcaactttcgcgcttaattataaaattaagtacaatgaagacaataaattgattgcgcagatagatgaatacctggacgacacctttatgttgttcagcagctatggtattaatacgcaggatttgcaaaaatggcgtaaatcgggcaaccgcctgttccgttgtttcgtcaacgccaccagggctaatcctgttagtttgtcttgttaaaaattattacaatcataggtagaatttatgtctgataaaccattaactaaaactgattatttgatgcgtttacggcgctgtcagacaattgacactctggagcgcgtcattgagaaaaataaatatgaattgtccgacaatgagctggctgtattttactcagctgcggatcaccgtcttgcagaattgacgatgaacaaactctacgacaagatcccctcttcagtatggaaattcattcgttaatcacgctacattactttttagagaacacgcaggtgttatctgcctcctcgttctggctaataacacaacgggctattatagaacagtgatatagatcacataccaatagcagggaacgttccctctaatactttattattgcttctattgcgataatatccaccaaggggagcgcgcgatgagtgacgaaaaacaaaaaatgatcgctggggcactgtattgcccgaccgatgaaactttatgccaggatcgactgcgggcgcgtcaactcatccatcaatacaattatactacgcctgatgaaataaataagcgtcaggcgattttacgcgacctgttgggtcgatgcgaagacgcctatattgaaccttccttccgttgcgactacggctataatatttttcttggtcactccttttacgctaacttcgactgcgtcatgcttgatgtttgcccaattcatattggcgataattgtatgctcgcgccaggggtacatatctataccgccacgcacccgctggacgccgtcgaacgcaacagcggcagagaattaggtaaacccgtcactatcggaaataacgtctggataggcggacgagccgtcgttaatcctggcgtaaccatcggcgataacgtcgtcgtcgcttcaggcgctgtggtgacaaaaaacgtaccgccagacgtcgtggtaggcggaaatccggcgcgaatcattaaaaaattgtagttcaaatgataactgttatgctaattcgtggttaatctgttacttttttcacgttacacctccctttaaaatgggctgttactaccccctatgtcgcagaaatcatgaaggcaaaagatgacagagatacagcgcctgcttagcgaaactattgatgacttaaacgtccgtgaaaaacgcgataacaggccgcgttttagtataagttttatccgcaagcatcctgggttatttatcgcgatgtatgcagcctggtttgcgacgctggcggtcatgctgcaatcagaaacgctggtggggtcagtgtggctgttagtggtgttatttatcgcatttaatggcttcttctttttcgacatcgccccgcgttatcactataacgacatcgatgtgctggacctccgggtctgttacaacggcgaatggtacaacacccgctttgttccccccacgctcattgagacgattcttcagtctccacaggtggataatgaacataaagtccagctgcaaaaaatggttgcccgtaagggcgaactttccttctacgatatttttacgctggcccgcgcagaagccagccggtaataaaaaagtgcgcaccctccctggtacgcactgctttccctgaactgttggttttttaacgtctttttttacgcccctgaaccgccttaaaacgcggatttgttttacaaatcacgtataagcgtcctttgcgtttgactatctggcaatccggatgccgttgttttgcattgcgaagtgagtttaacacctgcatttcatttacccccgtttagcgccgataaaatgaccaaaacgtttctggaagcgtgcggcgctactttcgctatcaaacgttttctgtctaccggtataaaaaggatgcgattttgatgacacatcaatagtgacatacggatatgtcacgccgtccagttcgatttcacgttcagttttgatagttgatcccactttcacatattcatttgcgctggtgtcgtgaaatacgacggttcggtatacaggatgaatatcaggtttcattgcgctctctcaattatgttataacataacaataaaatacgctatcaacgctcctttttcaaccggtaaacattcacgatctcttcctggcggcaaaagcaacgtggcgtaacgcgttagtctggcccctgtatctgtaaaatcgataaaatagctttatcattcgagggcgcgatttacgatcggatatactttctctacgctgtgtttataaggacatcactgtgacaacacgacatctggtcagcctggtaacgggagtgcttatcctgtctgtccttttcccgataggattgagcctgtggctggcgcaccgtcaagttgaaaaaaggtttaacgaagagctggatatcttctcgtcccgggtggcgctacgtacagaaagggtcagtgaccaggcaaaagccgcgttaacgcatattgcctcctttaaaggcgagccctgcagcagcgcccatttactcgccatgcgccgcgtgtcttatagctttcggtatgtccaggaagttctgtatcttaaaaattcgattcccgtttgctcctcacttgaaaaagagagccatattcccgctttccctccgcccatgaaaatcactcgcgacggttatcgcgcctggtttacggcgcaaaacgatctgggtataaaacgctatatggcggcactcgggagcgacagctatatcgtgatgatcgacccggcgtcctttatcgatgtgattccgtttggcgcatggccgattgacgtcgctattattggccgggaacgcaatactgtggttgccagcagcggtaaccttgaccacgctattcttccgctcattcaccatgagacgcccctgcggctggaaaaccgaggcattcagtatgctatccacccctttccggaaatgggcattactatcgtaagctgggcaccgaccgctccgctggaaaggagctggtatcgacaagcgtttatctggctaccggcgggcatcgtaacgggtctgctggctgcggcctttattctgcgtattttgcgtcggctacaatcgccccgccaccgtctccaggatgcgatagacaatcgcgaaattaacgtacactatcagcctattgtctccctgagcagcggaaaaattgtcggtgccgaagccttagctcgctggcaacaggcggacggcactttcctttcgccggaaatttttatcgcgctggctgaacaaaccgggctcacggagccgctaacccggctaatcatcgacaccgtttttgaagacatggggagttggttaaagtcccatcccgaacaacatatttcaatcaatcttgaggcatccgatctggcgtcggaaacgctcccgacgctgttaagcacgctgctgaaccgtagccaaatttctccgtcgcaaatcgcgcttgagttaacggagcgcgagttcgccgatccgaaaaccagcgcgcccattgtcgccagataccgtaacgcgggacattccatttatattgatgactttggcaccggctattccagcctcagctacttacaaaatctggatgtggatgtccttaaaattgataaatcttttgtcgatgcgctggaatataaaaacgtcacgccgcatattattgaaatggcgaaaacgctcaaacttaagatggtcgcagaaggcatcgaaacgaccaggcaagaacagtggctacgccagcatggcgtacattatggtcagggctggttatacagtaagcccctacccgctacggcatttattctttgggtggaacagcggctataacgtcgcacagcagaaaagaacagtgtggaaaggcagaattgggtgggggccctgccagctacatcccggcacacgcgtcatctgccttggctgcttccttccggacctgacctggtaaacagagtagcgttgcgggagaaccaacagagcccccattgagagcgttgtgaaccaacgcgcaggcgcattatcactgctatatcgtgcaattgcaacctatcaggcatcggatgctggtttcttgcgcatccgggctttcctccccccttattccagattatcctgaagcattaacgcaggattctattatggatattcaggacacatttcctcaacgcgtctggcaaatcgtcgcctcgatcccggaagggtttgtcacgacctacggtgatgtcgcccggcttgccggttcccctcgggcggcgcgtcaggtcggcggagttttaaaacgtctgccggaaggcagcactttaccatggcatcgggtggtgaaccgccacggcgcaatatcacttaccgggccggatctacagcggcaacgtcaggcattactggcggaaggcgtggtggtgtcgggaagcggacaaatcgatttacaacgctatcgctgggtgtattaaccctctccgtaacggagagggttggcgcaggattaatactgggtaggcgcaggaacggcagaagacggattgacctgggtcggcgaagtcgatggaaccgtcgtcgtcgcaccgccgctggcctgcacaggcaccgccgtttgctgtaccggtaccagcgtcagatccgctttagtgccgccattgttaatcaccggtttcacgctatcggtaataaataccagcttattgtcaacggtgatggccgcgctcagaagaatacgcgcgttaggttgaatatctgatgggttaaacggcaacacaaaactgaaaggcgcctgtttaccttcggtacgtaccgctttttgcgacagcaccttagacggcgcatcagccagcgaagcatctgaaagcgtcacggtcagcaccgcatctggcggcagagcgaccttctggcggatccagacggtaccggaaacattgggttgctgaatagtagactggttagctgtaatcgacatgttagggtttggcgcaggcgtctggatatcagcgcttttatcagcgcaggccgccagagatatcgcaaccgctaaaccacttacgatgtgcacgagtttcattcaattctccttatcatcaatgcaccagcaggcctttccccccgccggaagagtggttaacagaaatacaacgtgattaagtgtggcacatgtcactcatttttgcctggaattggtctgttattcagacttttgtacccatcggaccacttgcaaaattgcgttatactctgccctacctcgcttcggcatcgttgtcacctggagagtatgtatgagtcagacactgaataatttgctgacattattgaatctggaaaaaattgaagaaggactctttcggggccaaagtgaagacttagggctgcgccaggtatttggcggtcaggtggtgggccaggcgctctatgccgccaaagaaacggtgccggaagcgcgactggtgcattcattccacagttattttctgcggccaggcgacagccaaaaacccattatctatgacgtagaagtgctgcgcgatgggaatagcttcagcgcccgccgcgttgccgctattcagaacgggaaacccatcttttacatgaccgcctcattccaggcaccggaaccgggttttgaacatcaaaaaaccatgccgacggcagtcgggccggaaggactaccgtcagaaacggaaatcgcgcaatcgctggcgcatttactgccgccgattctgaaagaaaagtttctctgcgatcgcccgctggaaattcgtcccgtcgaatttcacaatccgttgaaaggtcacgtctccgcgcctgtgcgtcaggtatggattcgcgccaacggcaccgttccggatgacattcgcgtccatcaatatttactgggatacgcctcggatctgaatttccttcccgtcgcgcttcagcctcacggcatcggttttctggaaaagggcattcagatcgccactatcgatcactctatgtggttccatcgtccgttcaattttaatgaatggctactttatagcgtggagagcacttccgcctccagcgcccggggctttgttcgcggcgagttttatactcaggatggcgcgctggtcgcttcaaccgtgcaggaaggggtaatgcgtaatcacaattaaaaaacatgccgctatgcggcgttaatggcctgatgacgctgcgcttatccggcctacggtagactgggtaagcgcagcgccatcaggcatgttgcgcaatcacgcgttatacgcattctcgccgtgactgttcacatccagcccctcgcgctcctgctcttccggtacacgcagtccaacaaggatatccgccagtttgtaaccaacaaacgcgacaacgccggaccagacgaccgtaatagcaatactttccagctgtaccatcacctgatgtcccatcgtaacgccgtcgacaaagccgacgccacccagcgaactggcggcaaaaacgccggtcaggatacagccgactattccgcaaacgccgtgaacgccaaatacgtcgcacggatcatctacccgtagcagacgtttaagcatggtgactccccacaatcccgccagacccgcaataacgccgataaccagcgcgccgccaacgccaacatagccacaggctggcgtcacgccgaccagaccggcaatcgcgccggaacacgctcccagcagggaaggcttaccgcgtagcgtccactcgccgataatccaccccagaatcgcggcggcggtcgccaccacggtgttcacaaaggccagcgctgctatctcgtttgcgctacccgcagaacccgcgttaaatccaaaccagccgatatacagaatcgcagtaccggtaaagaccatcggcaggttatggggtttaaatgcttctttcccaaagccgacgcgtttgccaattaaataagcccccaccagcccggcgatagcggcgttaatatgcaccaccgtaccaccggcaaaatccagcgcgccgtgagcagccagcaggccgccgccccacaccatgtgcgcaatcgggatataagagagcgtgaaccacaccacgacaaaaatcagtaccgccgaaaaacgaatacgctccgccagcgcgccgacaatcagcccgacggtaatacaggcgaaagatccctgaaacgcgacatgaatatactgataaatcgtacccgttaccgccgtcaacgcgatattcttcaacatcgccccatcggcattaccgaagaaatgattcccttcgccaaaagccagcgaatagccgtacaccacccataaaatacagaccagcgcaaaggtgacggtcacttgcgttaacattgacagcacattcttggcgcgaattaatccgccgtaaaacagcgcgatacccggtatcgtcatgaacagcaccagcgcggtgcaaatcatcataaaagcactatccgctttatcggcaaccgctggcgcggctatcgttagcccaggcagcagcgccagtgaagccagtgtggtttttatcatcgctatcttcattttttcatttcctgttgctgtgtggcgggtcttacagcgctgcttcgtcagcttcgccggtacgaatccgaataacgcgcatgagctccgcgacgaaaattttgccgtcgccaatttttccggtgtaagccgctttactgatgatatcgatcacctcttccagttggtcgtcggcgatagccacatcaattttgaccttcggcaggaaattcacgctgtactccgcgccgcgatacagttcggcgtgtcctttctgacggccaaaccctttcacttcggtgacggtcagtccctgaatgccaatggaagaaagcgcctcccgcacgtcctccagcttgaacggtttgataatcacggtaaccagcttcatagaaccctccagtcagaattaggtaacggctgccgccgcgcatggactcttcaggatggatattgcaaaggatgtgccagaagctggcgagcgaggaaaagcgcggttagcggcgcgtctttatattgacgcgccccaaaaacgaagcagggaaagaaaaacgcaccacgacggtgcataatgggcgaggttttgccctgtggcgccaaaccttacgccgtagggccggattcttcgtgtacgctggcggctaactcctcgccaactaactgtaattgatacatttgccagtagcgcccttgcgccgccagcaattgttgatgcgtcccgcgctccaccgcctggccgcgatagagaaccagaatggtatccgcctccacgattgtcgatagccgatgggcaataaccaccaacgtggtgcgctcgcgaatcgccgccagcgcctgctgtatcgcctgctcagtgccggaatcgatgctggccgtcgcttcatcaagaattaatatttgcggggcgtcaaccagcacgcgcgccagcgccaatagctgtttttgcccgacggacagcgtatttccctgctcgccgagatgcgtatgcagcccgtcgctcaggccgcgcgccagatctgccagttgtaccgtttccagcgcctgccacacctgcgcctcggagacatcgcgccccagcgtcacattagccagaaaggtatccgccatcactaccgggtcctgttgaaccatcgccacgccctggcgtaaaacgcgatgattaagagaggcgatttctcgcccatccagccgaatttcgccttgtgtcagggggtaataccccattaataagctggcgagcgtgctcttcccgctgccggtgtgccccaccagcgccacaaagctacgggacggtactgatagcgtaatgtcctgtaaaacaagattatcgtcgcggtaagcaaacgacagatgatcaatatcaatcgccccgctttgtaacggcctgtcgtcgctgccatagcgctggcgcgggcgatccatcagttcaaaaacacgctctcccgccacaaccgcctgctgtagcatggattgctgggtggtcagttcaatgagcggctcgttcagacgtgacaaatagctaatgaacgcatacagcaccccgacctcaatcgtgccggcagacgtaaagctgaaaagcatcaacaaaccgcataaaatgagcgcggaaaagaggctaagcagcggacgcaataaaaagccgtccaagcgcagcgtctgcatccgcgccatgtagtgcgagcggctggcctcgcccatgcgttcgccgaagcgcgcctgctggcgaaactgctgaattacgctcatcccattgatgatttcgttaaagccgtcgttaatatccgccaggtatgcccgcacgcggcgtacaatcggcgtgctgtagcgctgataaatgaccatcacggtcaataccgccggaaaaatcaaaaccgccaccagcgccatccgccagtcaaggctgaacatggcgaccagcatggcgccgatcaacgccgcgctacgtaataccgttgcgacgaccgtgacgtacagatcgcggatgacttccgtatcgttggtcacgcgtgaaattaattgtccgacaggctgcgtgtcgaaggcgcttagcggctggcgcaaggcggcatccatgacgtccgtgcgcaaggactgaaccacgccaacggccgcccggttaaataataaagactgggcgtaatgcagacccgccgccagaaactgtagccccacataggcggccgccagccccgcgaccttgcccaacggtaaatggtggcgggccaccatgttatcaatgaaatagctgatcagcagcggaccgctaacctccgccgccaccgcaatccacagcatcatcaccgcgacagagagcggttttcgccatggcgagccatacgccagcaaccgtttcagcgtcggccatagctgtccaaaactacgcattcaccgcctcctcgccgcgttccggcgcgtcatccagagcggcctccagttgctgatagcgatacatatcgcgataccagccaatctgctgcgccagttgatcgtgatcgccgcgctgaacaacatgaccatgttgcataacgataatttcattggcgtcggtcagcgcggataaacgatgcgcgctgatgatgaccgtacgcccttcgccccactggcgcaaattatgcaaaatctgatgctccgtacgaccatctactgctgaaagcgcatcatcaagaagcagaatttccgcattcaacagtagcgctctggctatcgagatacgctgtttttgcccacccgataacatgacgccacgttcacctacctgcgtgtcatagccctgaggcaaacggagaatatcctcatgtacgctggctaaacgcgccacccgttcaatctcttcctgggtcgcctccgggcgtccgagcgcaatattattggcaatagaatccgagaacaaaaacggcgtctggctgacgaccgccagtcggctacgccagctatccagttgcagatgcgtcaacggcatgtcatggaatcggatctctccctgcgtcacatcaaaatggcgctggataagcgacaagattgtgcttttccccgcgccggtcggaccgcatatccccagcatctgacccggtttaagacgaaagttcacattctccagcgccggatgcgtcgtttgcggatagcaaaactcacgaatggccgccgtcagttcgccccgccccgccgggacgggctcttcgccatccttaactaccggcgcttccgccagcatggcgcggatgcggctgtaagcggcgctaccccgctccacgatattaaacatccaggccagcgccagcatcggccaaatcatcaaccccagatacatcataaagctggtgagttcgcccagcgtcaggctgccgttaaccaccatccagcttccgccgctaatcgcgagcaggttcgccatgccaatggcgatgtaaatggttggatcaaaacgcgcgtcaatacgcgccacgcgcatatttttcttgccggtatcttcggcatccgccgcaaacagcgaagactggcggtcctccagaccaaacgctttgatcatgcggatgctggtcagactctcctgcgtgcggtcgttcaggctggagaaggcggcctgcgccagtttgaaataatcatgcagtcgatcgccgtaacgtttgatcatcagcgccataatcggcatcggcaacagcgctaatagcgttagctgccagctaatttgcgtcgacatgacaatcagtaccgcgcagcccattaccagcgagtcaaccagcgtcagaacgccctcgcccgccgcaaatacgacgcgatccacatcattcgtcgcacgcgcaataagatcgcccgttcgatggcgctgataaaattcaggatgctgacgactcagctggcgataataatcttcacgcagttcgacggctaattgataagaagcgccaaatagcagcacgcgccagacatagcgcaacaaatagaccactacggcgatcagggcaatggtgccaatccacatcgctattcggcctggagtaaaatgctgtgcggttacgccatccacgacaatccccaccactttgggcgggatcagctgaagcatcgcaataagcataagcagggccaccgcgccaagatagcgacgccattcccggcgaaagtaccagcttaattgagcaaataatcgcacgcgttatttcctgatatgatttccggcaataccgggagaattattcaatgggcagagaggtggtgtacttaatctgttccatcgcaaaactggaggtgacgtctgacagtcctgggacgctattgaccagacgtttatagaagtcgtcataccgcttcatgtcggccacctgaactcgcatcagatagtcgtactcccccgccatccgccagaagccaagcacttccggcatctcagagacgacggtcacgaaccgacagtaccattcactgctgtggtgctgcgtttttatcaacacaaaagcggttaaccccagccccagtttttccgggtccagcagcgcaaccctgccaagcaggataccgtcatcttccaggcgtttaagccgcttccagcaaggcgttgtcgtcagattaacggcatccgccagcgcctgcaaagagagggtacagtcctgctgcaataagcaaagcagtttacggtcaattttatctaacatacccactccatagagaatatttttctccttacattgtaatttaaaggtcaaatagcaacaattttttccgtacttttcgctactcttggcacaaaatgataaatggatattaatgatgagtagcaattgggttaaaaatgccattaatgaaattaacgctgaccaccagcgctcagcggatacgcatcttattcgtttgcccctgtcggcatttccaggtatccagctttacctgaaagacgaaagcacgcatcccaccggtagcctcaagcatcgtctggcgcgctcgctgttcctttatgggttgtgcaatggctggattaaagaagacactccgattattgaagcgtcatcaggctcaacggcgatttccgaagcctggttcgcgcgtttactgggactgccgttcatcgccgccatgcccgcctgtaccgcaaaacgtaaaatcgaacagattcaattttacggcggccactgtcattttgtggagagcgcctgcgaaatttatgccgcctccgagcggctggcgcatgaactgaacggtcactatatggaccagtttacctacgcagaacgagctaccgactggcggggcaacaataatattgccgacagtattttccgccagatgcgcaacgaaccccatccggtaccgcgatttatcgtcatgagcgccggaacgggcggaacctctgcgacgattgggcgctatattcgctgccagggctatgatactcagctcatggtggtggatccggaaaattctgtctttttaccttactggcaggatcgcgacgcttcattacgcagcccggtaggcagtaaaattgaaggaattggtcgtccgcgagtagagccttcttttattccggatgtcgtggatgagatgctgcgcgtgccggacgccgccagcgttgccaccgcacactggctggaaacgcagctaggccgtaaagtcggcgcctctaccggcacgaatatgtggggagcgctgcagctagcggcccggatgcgcgaggctggagaaaccggcgctatcgtgacgttattgtgcgatagcggcgatcgctatctggatacctattaccatccggcctgggttagcgaccatatcggcgatttgacgccgtggtcagcggccatcgcaaaattacttaccggcgactagaaaccaaataaatatcctccggcatagccggaggtttttctgatgcgcctgtaaggctctcttaccagccgcgccctaacaggcgcatacgatctgacatttgcatcaaacttcgttacttacggcccgtaaacaggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcgtcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtccctcattgggacccccttttgatttcttgttgaacttttgcagttgccagaccgcaagatgttttaacaaatcaaaaggggttttaataactggcttaaagctgaaagctttccggaacccccagcctagttgggggttttccatagacaaaaaaagccagactgaatgtttggcttgctggaagagatctctcattcgggggaataaggtagatgcggattgtccagccaatgcgtcaaaaagtgtgataccgcttgattaccacaatgtccgataaccgaaaggtgtggcagcgcggcgataagctgcggcatggcattgcccataatgagcccccgcccgacgctgcccagcatttcccgatcgttcatcgcgtcgccaaacgccatgcaatctgccagtgaaagccctaaatggttgctcaataccgccagcgccgatcctttattgcaccccagcggtagcacttccaggcagtcgacggcagagaaacagaggtgcgcgcgttcttccagcgcctcattgagctgaatgcgcaaacggatcagatcgtcatgatcgccgcaaaaacagatcttcgtcacctgatgggccggaatactttttatatcgataacctgataacgaaagccgctgtagacgtgcgcctggagtagcgcggggatctcctggcctgtaaaccagccgttgtcattaaacacatgcatactggctcgggtatcccaggcatggtgcatcaccgtatcggcaacctgaggatcgagatcctgacgatgcagcacgtcgccttccagcgagtgaattcgcgtcccgttaccggtaataagataagcatccagtgaaagcgtccccagaatatgccgcatctccagcacgtgacgacccgtagcgaatgtcagagtgatatcgcgttcgcgcagacgcgacagcgtggcgatcgtttctctacccaaatggtgatcgggcattaataacgtgccatccatatcaaatgctgccagacgggccatctctttctccacactgtaacgcggttaacttgttgttcagtattacctgagatatacggaagtaatagtgaacagataaaaggaagtgttccgggttttatgaggctactgaatcggcttaatcaatatcaacgcctctggcagccttccgccggggaaacgcaacatgtcaccgttagcgaactggccgaacgctgtttttgtagcgagcgccatctgcgaacgctgctgcgtcaggcccagcaggcgggttggctaagatgggaggcgcagtccgggcgcgggaaacgtggacggctccagtttctggtcacgccggaatcgctccgcaccgccatgatggaacaggcgctggaaaaagggcagcagctcaacgtactggaactggcgcagctggcgcctggcgagttacgggcgatgctccagccttttatgggcggccaatggcaaaacgatacgccaacattgcgtattccctactatcgtccgcttgatccgctgcagccgggtttcctgccaggacgcgcggaacagcatctcgcagggcaagttttttccgggttaacgcgcttcgatcgcgatagccaatatccttgcggggatttggcgcatcactggaaggtttccgccgacggtttacgctgggatttttatattcgctccacgctgcactggcataatggcgatgcggtggataccgcgcagttacacgaacgcctggaaaggctgcttaccctaccggcgctaagcaaattgtttattagcgtcgcacggatcgaagtaacgcatcctcagtgcctgacctttctccttcaccgacctgattactggctggcgcatcgtctggcgagctattgtagcggtctggcgcatcctgacctgccgcttatcggcaccggtccttttcgcctggcgttgttcacgccggaactggtgcgtctggaaagtcatgaccattatcacctcagccatccgctgctgaaagcgattgaattctggatcaccccgcaactgtttgcccaggatctgggcaccagttgccgccatccggtgcagattgccatcggcaaaccggaagagctggcgacgctgagtcaggtaagtagtggtatcagtcttggcttttgttatttaaccctcaaaaagggctcacggctcaacgtacagcaggcgcggcgtctgatacatattatccatcatacttcgctgctgaaaaccttaccggtagatgagaacttgattatgccaagtcaggggctgctacccggctggacaatcccgcaatggcaggacgttgatgaaacaccattgccgaaaaaacttaccctggcgtatcaccttcccgtagagctgcatacgatggcggaacagcttcgacattacctggcgacgctcggctgtgagttaacgttgatttttcataatgccaaaaactggaataactgccctgcgttggcgcaagcggatctgatgatgggcgacaggctgatcggcgaagcgccggaatatacgctggagcagtggctacgttgcgatcagatctggtcacatgtcctggacgcgcctgcgttttcccatctgcaggctacgcttgacgctctgcaaattcagcccaatgaaaaagatcgccgcgccgcgctacaacaagtttttgccaacctgatggatgacgccacacttacgccgctgtttaattatcactatcgcatcagcgccccaccgggcgttaacggcgttcgactcacccctcgcggctggtttgaatttagcgaagcctggcttccgccgccttcgccgtgaagaagctggtcgggattatccgtacgcgttaccatattggctttcgtcattgatcaggataactatgaaacgcgccgttgttgtatttagtggaggtcaggactccaccacttgtctggcgcaagcgcggcatcagtatgatgaagtgcattgtgtcacgtttgattatggtcagcgccaccgcgcagagattgatgttgcgcgcgcactggcgttaaaacttggcgcacgcgcgcataaagtgctggatgtcactttgctgaacgaactggcggtcagcagcctgacgcgggatagcattccggtgccggactatgaaccgaacgctgacggtatccccaacactttcgtaccgggacgcaatattctctttctgacgctggcggcgatttacgcttatcaggtcaaagccgaggcggtgatcaccggcgtttgcgagaccgatttttccggctatccagactgtcgcgatgagttcgtcaaagcgctgaatcacgcggtgaatctgggcatggcgaaagatatccgtttcgaaacgcccctaatgtggattgataaagctgaaacctgggcgctggccgattattggggccaactggatttagttcgcgaagagacgctgacctgctataacggcattaaaggcgatggctgtggtcattgcgcagcctgtaatctgcgcgctaacggcctgaatcattatctgtcgaataaagcggcggtgatggcggcaatgaagcaaaaaaccgggttaaggtgattgttttgccggatggcggcgcacgcaccttatccgtgcctggcgatatgcaccatggtcaatatcgccaggccggacaagttcaacgccatcagacagcgaggcgttattgcaccatctgttccagcttttcacgcaattcgccttccagcggcagcgctttttgcgtttttaaatcaatacaaacaaacgtgatgagcgcatcggccaccacctgcccttctggctccagcgtaatcgtctggcttaatacgccgcttttaccgttaagctgttgtacctggctggtcacggtcagtagatcgctcaataccgccgggcgacggtaatttatattgatgtttaccaccacaaaggcaatattgcgggccgtcatccactgaaagctgtcgctgttttccagcccatcccaacgggcctcttccagaaattccagatagcgggcattattaacatgttgataaacatcaagatgatatccacgaactttgatttgtgtttgcatagcgcaataaccttacgttgttgttataagtaagcgacaagtacagaggtcataactggtatgacctctacagtctggcaaattttggccactgtgcaagtgattacaatgttaaaactgccagattacgctccaccagcgcgcttcccattcccggcacctgctttaaatcatccaccgttttaaaaggaccatactcctcccgatagctcacaatagcctgcgcttttttcagcccaacgccgttcatcacccgcgccagatcctccgcagacgcggtattaatgctcaccctagtaccttcatcatcgctggctttagcaggtaatgccgctttggcggaggatgaagaaggcgtatccgcttttgtttccaccgctgcattttttgcgacaggcgtcgccgccagcgcgctatgggccatgcccgcgcaggttaaagaaagcgtaataagcagtgctttaattccgtgtttcatactgttttctccttgtttgttaacagtgcagccacgatagcggggcggagaaaaacgaacaaatggcaattctcagaaatggaaaaggccgcgaaagcggcctttgtgggatacaacgttttgcaattttttgcgaagcgcctcgacgattactgctgttccagagcgtcgccgattttgattttcgcctctttacgcagattgctcatcagcgcctcaaagacaatttgcgcattgttctgcgtgatgccctgcaccatcgcttttttctgcgcttccggcatggcgcccgctttcacctcgtcaaacgccagcagaacgacgttaccctgcatatcgttcgccacgccataaactggcttatctttcgtcggaaggcttaacgcaaaggccgcctgactcaccggatcctgactggtacgacttaacgttttaggctcgccaaaactcagacccgccgctttcatcgcttccgcgcctttgcccgctttcagctcgaccagcagtttttccgcatccagcttcgcctgttgttccgctttgttatgcttcaccagggcagtgacctgttctttcacttctgccaacggcttcacggcttcaggtttatgttcgctcacgcgcacaacaaaagcccggtcgccatctacggtgataatgtctgaattcggccccggcgtaccgttttcgcctaccagaccgccattaaagatagcatcggctaccggtttgaagttcagctcttccggtaaggtgtcacggctaaaccagccggtttcaacggcttttacgccagcgacctgttcagcgcctgctaacgactcattgtcgttgcttgccgcatcgctcaccttctgctgcaacgcatagtaagcatccagcgctttttcctgtttcactttcgcggcaatgtcgtcgcgaacctcgcttaacggtttcactttggcaggctgaatatcatccagacgcgccaccagaaaaccgacagacgacttaatcacgccagatatctggcctttttcttttaatccggcgtttttcagttccggcaccgtggcagactcttccagccagcccatatcgccgccattacgcgcagagatgatatcggtagatttctctttcgccagcgtggcgaaatcttcgcccttgttcagcgcatccagtaccgctttcgcatcatcttccgttttggtctgaataatgctgtaacgaatgcgctccggctgagtaaactgatctacatgctggtcataataggcctgaatatccgcatcgctgaccggtgcctgcatcgtcgcggcatccagcttgatatagcttacgcggaactgttccggcgtcataaagcggactttattctgatcgtagtagctggacacttcctgatcggtcacctgctgcttcgccgccagcgcgttgacatcaataacggcttcacgcaccacgcgctgttgagagactaatgccgccagttcgtcggtttcccctttcagcataaaatcagtaccggccacgccgttgatcagttgctgagtggtaagctggttacgcagcgcctgagtatactgatcggccgtcattcccatctgattcacaatcgcgttatagcggttgttgtcaaacttaccgtccacctgaaaagcgggagtggcgaaaatcgcctgctttacctgctcatcgctgatgcccagtttcagttcgcgggaatattgatccaacagcgcttcatctatcagacgattcagcacctgctggcgcaggcttttcatataaccttcgttggccgccagttcagaatacctgtcgcccaactgctgctgcatacggttacgttcgttgttaaacgcattctcaaactgtgcccggctgatttcctggccattcacttttgcggcgtagttattgcttccgccaatcaggtaaccactaacgccggtcaaaatgaacgacacgataatgataacgaaaataatcttgagcacgagactgtttgcagccgtgcgtaagctgtccatcatggtgtaaccacactccgctgtaggtgactttacactttatctttcaggcggcttctctgctggctactgagtgcttcgctcagtagccgcgtcgacgcaacctgaatgatttgcgtatatagacttcacgcgcatcgcattttctgaacgcggcgcacaaaagcctattgtgacaagaaacgagggcaattgtcagcccgcaacgcacagaaagtcccgaatcgccaataaaaaaggcacatcagttgatgcgcccttgtactttgtcacatcccccgaggggatcacgcttagtttaccgcgtctttcagcgctttacctgcacggaaactcggcactttggcagcggcgatggtgatctctttacctgtttgcgggttgcgaccagtacgggcagcacgctctttaacagcaaaagtaccaaagcctaccagtgcaacgtcatccccttctttcagagattcggtaacagaagcaataatcgcatctaacgcacgtccagccgcagccttagagatatcagcccctgcagcaattttttcgatcagttgagatttattcactcttctcttcctctttataatttatatcgcacctgaatccttcgaagtacgaccgcgcagcagttatatcaggcctgccacgcccttacaacacccgttaatggtggcagacccaatcaaccatctaaattagctatacaaaaaaaggctggcaagtccgaaatagcctgccagccctgtttttattagcgctatttgcgcgaggtcactattttgcggttacaacctgcattccagacggttcgttttgcagagcaagcgtcagaacttcctcaatgcgcttcacaggatgaatatccagatcggcaatcacgttgtccggaatttcctccagatcacgtttattttcgaatggaattaagaccgttttaatcccgccgcgatgcgccgccaacagtttttctttcaggccgccgatcggcaacacctgaccacgcagcgtgatctcaccggtcattgccacatctgcgcgcaccggattaccggtcaggcaggaaaccagcgcggtacacatcgcgataccggcgcttggaccgtctttcggcgttgcgccttccggcacgtgaacgtggatatcgcgtttttcgtaaaagtccggattaatacccagtttttccgcgcgcgcgcgcaccacggtcagcgccgcctgaatagattcctgcatcacttcaccgagcgagccggtgtaggtcagcttgcctttgcccggtacgcaggcggtttcgatggtcaacagatcgccgcccacttccgtccacgccagccccgtcacctgacccacgcggttttcgctatccgcgcggccataatcaaagcgctgcacaccgaggtagtcgtgcagattatcgccgttaatttcaatatgttttaacgacttatcgagcaacagttgtttaaccgctttacggcacagtttggagatttcacgctccagactacgaacgcccgcttcacgcgtgtaatagcggataataccgataatcgcgctatcgtcgaccgtcagttcgcctttcttcagcgcgttacgctcgatctgcttcggcagcaggtgacgtttagcaatattcagcttctcgtcttcggtataaccggacagacggatcacttccatacgatccagcagcggcgccggaatgttcatggagttggaggtggcgacgaacatcacatcgctgagatcgtaatccacttccaggtaatgatcgctgaacgccacgttctgctccgggtccagcacctcaagcagtgcggaagccggatcgccgcgcatgtccgaggacattttgtcgatctcatcgagcaggaatagtgggtttttaacccccactttggccattttttggatcagtttacccggcatagagccaatgtaagtccggcgatgaccgcggatttccgcttcatcacgcacgccgcccagcgccatacggacgtatttacgccctgtggctttagcgatggactggcccaacgaggttttacctacccccggcggccccaccagacacaggatcggccccttgattttatttacacggctttgtaccgcgagatactcaaggatgcggtctttcacacgctccagaccataatggtcagtatcgaggatttcctgcgcctgacgcaggtcttttttgaccttgctacgcgcattccacggcacctgcaccatccagtcgatgtagccgcgcaccacggtcgcttccgccgacatcggagacatcattttcagcttctgcagttccgcttccgctttctctttcgcctctttcggcattttcgccgcgtcgatcttacgcttcagcgcttcgttttcgtccggcgcgtcgtccatctcgccaagttctttctgaatcgctttcatttgctcgttcagatagtactcgcgctgggatttctccatctgctttttcacgcggttgcgaatgcgtttctcaacctgcagcagatcgatttcagattccatcatcgccatcagatattccagacgttcgttaacgtcggacatctccagtacggactgtttatccgccagtttcagcggcatatgcgcggcgatggtgtcagccagacgtgcagggtcgtcaatgctattgagtgacgtcagcacttccggcggaatttttttgttcagcttgatgtagccttcgaactggctgatagcggtacgcaccagcacttcttgttcacgctcatcaatggctggcgaatcaaggtactccgccttcgcggagaaatgttcgccgttgtcagacagcgcggaaatacgcgcgcgctgtaacccctcaaccagcacttttacggtgccgtcaggcagtttcagcatctgcaaaatagaggccacggtcccgacggtgaaaagatcgtttacacccggctcatccgttgatgcttccttctgggcgaccagcatgatttttttatcatggtccatagccgcttccagacaacggatagatttttcccgccctacaaataagggtatgaccatgtgcggataaaccaccacatcgcgcaagggcaatacggggatttcaatgcgttcagaacgctcaggattcatagagctctctcttagtttagtgtccgccaggtaatcagatagtatagctgtgctccataccacctataacatgtacgtcagtatatggggatgtttcccacacattcaacggcgtgtttacaggaaaaacgaaaggggagataaaatccccccttttttggctaactgattgtatgaatgtttaattattcgccagaagcctgcgcttccggtttgccgtaaatcagcaacggcttactctgaccggcaataacggactcgtcaatcaccactttttcgacgtcttccatagatggcaaatcgtacatggtatccagcagcgccgcttcgacgatagaacgcaggccacgggcaccagttttacgcgccatcgctttcctggcgatagcgttcagcgcttcgtcacggaattccagatcgacgccttccaggttaaacagcgcctgatactgcttggtcagcgcatttttcggctctttcaggatttgaaccagcgcttcttcgctgagttcgttcagcgtcgccaccactggcagacgaccgataaactcaggaatcagaccaaatttgatcaaatcttccggttcaacctgcgacaacagctcgccttcactggctttgtcggacttcgctttcaccgtcgcgccaaaaccaatgccggagccggtttcaacacggttagcgatcactttatccagaccggcaaacgcgccgccgcagataaacagaatcttagaggtatctacctgtaagaactcctgctgcggatgtttgcgaccgccctgcggtggaaccgcggcgacggtgccttcgatcagtttcagcaacgcctgctgtacgccttcgccggaaacatcgcgggtaatggacggattgtctgatttacgcgaaatcttatcgatttcatcaatgtagacaatcccacgctgcgctttttgcacgtcgtagtcgcatttctgcaacagtttctgaatgatattctcgacgtcttcccccacgtaacccgcttcggtcagcgtggtcgcatccgccatagtgaacggcacatccagcaagcgcgccagcgtttccgccagcagcgttttaccggaaccggtcggtccagtcagcagaatgttgcttttgcctaactcgacgccattgctggtatcgccgttacgcagacgcttgtagtggttatagaccgccaccgccagcacttttttcgcctgctcctggccgataacgtaatcgtccaggtgagtacgaatttcatgcggcgtcggcagcgcactacgttcacggtgcggagcaacttctttaatttcttcgcgaataatgtcgttacataaatcgacgcattcgtcgcagatatacacggatggaccggcaatcagcttgcgcacttcatgctggcttttgccgcaaaaagagcagtacaacaatttgcccgagccatctttgcgtttatctgtcatgagtcaaaacctcttctttgttctttgtgccgcacacgacgacgcaaatgccattctcaggcgcaagccgctaatcagcgttgtgccgcccttcattagtatatacacaaaatcattcgagctacatcaaggcggcaactcagcgactccgcaggcgcttacataagtaagtcactgggaggcgcgctggcaaccaacaccgaggtagcgtgaaggatgaagtgtatagcggcacacttgcgtccagggcatcaattacgatgggtcaaaattgagtcaaccaaaccgtactctaccgcttcaggcgcggagaggaagcgatcgcgctcagtatcacgttcaatctgctcaagagattgacccgtatgatgcgccataagttcattcatgcgcccttttactttcaaaatttcgcgggcgtgaatttcaatatccgtcgcctggccctgatagccgcccagcggctggtggatcatgacgcgagagttcggcaagcagaaacgtttgcctttcgccccggcagtcagcagaaacgcccccatagaggccgcctgtcccatacaaatggtgctgacgtctggcttaataaactgcatggtgtcatagatggacatccccgcagtaattacgccgccaggagaattaatgtacagatagatatctttttccgggttttccgcttccaggaacagcatctgcgccacgatcaggttagccatatggtcttcgacctggccggtcagaaatatgacgcgttccttaagtagacgagaatagatatcaaaagagcgctcaccgcgtgaggtctgttcaatgaccatcggcaccagcgccatatgaggggccaaattatctcgttctccgctgtatgacatttccgtctcctggataaaaattgaaaaaatctgctgtactgattgtaacctgatggacggattatcagccagtccctctgtaatgggtacggcatcgccataattcaagcataacaatcttttgctctaacgctaacactgaaacgcggttttcgcacccttaccacgcaaaatgcgtgacaaaaaaaacccgtcactgaaaggtgacgggtttttgtgcaaatttcgtgcttttaacgcgaaaaattacgcctgctggttcatcagctcattgaaggaagtggctttttcagacactttcgcttttgccagaaccgcttcaacagcctgttcttccagagcgacgttacgcatattgtccatcagctctttatttttgctgtagaactcaatcacttctttcggatcttcgtaagcagaggccatctcttcgatcaggcctttaacgcgttcttcgtccgctttcagctcgttggtacgaatgacttcgccgagcagcagaccgacaactacacgacgcttagcctgttcttcgaacagttcgcgcggcagctccagagcctgtttctcgttaccaccaaaacgctgcgcagcttgacgacgcagaacgtcgatttcgctgtcgatcagcgcagacggtacgtcgatgtcgttagcttttaccagaccttcgatcgcctgagacttaacgcggttacgcaccgcgcctttcagctcgcgttccatgtttttacgtacttcagcgcgcagaccggctacggaaccatcttcaacgccgaaacgtttgatgaattcttcggtcagttccggcagttcgcgttcttcaactttcttcaggttgataacgaacttagccgctttacctttcaggttttcagcgtggtactcttccgggaaggtcacatcgatagtgaactcttcgccagctttgtggcctttaacgccgtcttcaaagcccggaatcatacgaccctggcccatcgccagaacgaaatcggtcgctttgccgccttcgaactcttcgccgtctacagagccggtgaaatcgatggtcacgcggtcttccgcatccgcagcgccgtctttttctttccaggtcgcctgctgcttacgcagggtgtccagcatcacatcaacgtcagcgtcggtgacttcaacaaccggcttttcaacttcgatggattcgaggccagtcagctcaacttccggatagacttcaaactcgacggagtaagtgaagtcttcacccactttgtattcgcccggaacatagttcggcgcgcctgccgggttaattttttctttgatgatcgcgtcaacgaagttgcggctcatcagatcgcccagcacgtcctggcgaacagaagcgccataacgctgagcgacgatattcatcggtactttgcctttacggaagccgtcaatacgtacttttttcgctacgttgaccagctcgctttttacagcggtctcgatgctgtcagcagcgattgtaatcgttacacggcggccaaggccctgagtggtttcaactgaaacttgcatcttgttacctcaaaaaatcacagtgctcggtcaactctactccgcaagcacgtgctatttgcttcgcggaaccgggatgttctcataatcaatcacattccctgtcgtcagaatcatcccgaagacgttcatatataagacggcgcattatagcggcatcacttttgtgagtcgagaacggtgattgtgcgatgctgcggcggttttcacaattctcggctaatttttgtctgaatactgtacgacacgctcaaaattcagacaaaataaaacggcccgcaggccgttttcacataattctgtagcaacatactggaaaagcggaggtagttgcaaatccgttttgctacgcgatgcttcccgcgccgcgacaaggaggcgacgcgaagatagtatcctgcaatccttcccactctttgagggtataagtatgcagtgccagcgcatgtacggttgtggaaagttccgccgttaacgtaccgtaaatcatccgatgacgattaagaaaacgttcgcctgtaaagcgatcgctcaccagcacgaccttaaaatggctttccgatcctgctggaacattgtgacgatagctttcatccacaacttcgagaaacacggggtcgaacgctgtccttaatttttcttctatttgctcacgtatcatcatgaaaatctcctccgacaacgctgtgatgtcacccatccctttaaatactagccgcttttaccgtttccattacagcatgacaacaaaaatttagctttcgtctgattatttcagccaaacgtatgaagtttactgccttaatcattcttttagcgctcaaaatccccgctcgcgccgttatcaataccaaatcggacattacgacgaatttacctgcgttgaccacttcccctcgccgttagcggtgttatgatggcgggaatttttacctatcacgttttaagcgtcattgagagcctgaatatgttaaaaaaacttctctttccgttagtcgctctgtttatgctggcaggatgcgccacaccgccgacgaccattgacgtcgcgccgaagatcaccttgccacagcaggacccgagcctgatgggcgtcaccgttagcattaccggcgcggaccaacgccaggatcaagcgttagcgaaagtcacgcgtaacaaccagttggtaacgttaaccgcctcccgcgatttacgcttcctgttacaagaagtcctggaaaaacagatgacggcgcggggctatatgatcgggcctaacggcgcggttaatctgcagattattgttaaccaactgtatgctgatgtttcccagggcagcgtgcgctacaacatcgcgaccaaagcggatatcgcgattattgcgaccgcggcaaatggcaacaagatgaccaaaaactatcgcgccaactactctattgaaggggcgttccaggcctctaaccagaatattgccgacgcggtgaacagcgttctgaccgataccattgctgatatgtctcaggacaccagcattcacgattttatcaagcaaaacgcccgttaatagcaacaacaagacccggcagaagccgggtctgtagatgcctatgtcaagtcaatatttacgtattttccagcaaccgcgttcagccattctgctgatattgggttttgcctccggtctcccgctggcgctcacttccggtacgctacaggcgtggatgaccgtcgagaatatcgatcttaaaacgattggcttcttctcgctggttggtcaggcctatgtgtttaagtttctctggtctccgctgatggaccgctacacgccgccttttttaggtcgacgtcgcggttggttactcgccacccaactgttgttactggcggcgattgcggcgatgggctttcttgaacccggcacgcagctacgctggatggcggcgctggcggtggtgattgctttttgctccgcctcgcaggatatcgtgttcgacgcctggaaaaccgatgtgttacccgcagaagaacgcggcgctggcgcggcaatcagcgtgcttggctaccggttggggatgctggtttccggcggactggcgctatggctggccgatcgctggctcggctggcagggcatgtactggctgatggcggcattgttgatcccctgcattatcgccaccttactggcgccggaaccgaccgatactatcccctccccgaaatcgctggaacaggccgtcgtcgcgccgctacgcgatttctttggccgtaacaacgcctggctgattttactgctcattgtgctttataaactgggtgacgccttcgccatgagcctgaccaccacctttttgattcgcggcgtcggctttgacgccggcgaagtcggtgtggtcaataaaacgttgggcctgctggcgacgatcgtcggcgcgttatacggcggcatattaatgcagcgtctttcgctgtttcgcgcgctgctgattttcggcattttgcaaggcgcgtccaacgccggttactggttgctctccattaccgataaaaacatgttcagcatgggcgcggcggtctttttcgaaaatctgtgcggcgggatgggtactgccgcctttgtcgccttattaatgacgctatgtaataagtcgttttccgcaacacagtttgccctactgtcggccctctccgcagtaggccgggtttatgttggtcctgtagcgggctggttcgttgaagcgcacggctggccgacattctacctcttctcggttgtcgccgccgttcccgggctgttactgttgctggtctgtcggcaaacgctggaatatagctggcagagcgagcgtttcattccccgcacgcaataccgtggcacctacaatttcgcgctttcaatcctgctcgcgggcgtcgctttgctggcggtgtgggtactcctgctgaccatgaacgcgttggattacactaacttttcattcctgcccgaattgcttgagactgcggtagcgattgccgtgtgcggcattgtctttggcgggttgctggactacctggcgctacgaaaaacacgcctgctgtaaaacattatttgccgttgtaataacgacccggaattataacggctaaataaccatcaattgataaaaaatatatttgtctttttgtgcgcaacagaattttggaaattattggtaatttctacgctacctattttctttacacgattcagccgactaaatttaaatttctaccgttgattgtccttttattgataataaattgttaagtaattgttttatttttacattggttataccaattatccctcaacatcccacttacagacctcatccgttataacgcaaagtttcaacagtgtcttaaagttatttcgacatacttggcaacatatgtgacacgcgcggcagaacttggtaacacagaaccaatcatgtttacagtaatgcaaccttaccgtaaaatgcccctacactttaaacgccaccaggtcccgtggaattgaggtcgttaaatgagactcaggaaatacaataaaagtttgggatggttgtcattaattgcaggcactgcattactcagtggctgtaattctgcgctgctggatcccaaaggacagattggactggagcaacgttcgctgatactgacggcatttggcctgatgttgatcgtcgttattcccgccatcttgatggctgttggttttgcctggaagtatcgtgcgagtaataaggatgcgaagtatagcccgaactggtcacactccaataaagtggaagccgtggtctggacggtgcctatcttaatcatcattttccttgccgtactgacctggaaaaccacgcacgcgcttgaaccaagcaagccgctggcgcatgacgaaaaaccgatcaccatcgaagtggtttccatggactggaaatggttcttcatctatccggagcagggtatcgccaccgtcaacgagatcgccttcccggcgaacacgccggtttatttcaaagtgacctccaactccgtgatgaactccttctttatcccgcgtctgggtagccagatttatgccatggccggtatgcaaacacgtttgcatctgatcgccaacgaacccggaacctacgatggcatctccgccagctatagcggcccgggcttctctggtatgaagtttaaagctatcgccaccaaagaccgcgcagaattcgaccaatgggtcgcaaaagcgaagcagtctccgaacaccatgaatgatatggcggcgttcgagaaagtggctatgccaagcgagtacaacaaggtggaatatttctccagcgtgaaaccagatttgttcaaggacgttattaacaaattcatgggccacggtaagagcatggacatgacccaacctgaaggtgagcacagctcgcatgaaggaatggaaggtatggacatgagccacgcggaatccgccaactccaagggttgaggaagataagatgttcggaaaattatcactggatgcagtaccgttccatgaacctatcgtcatggtaacgatcgctgcaattatcgtcgggggactggcgatactggcagcgattacttacttcggtaagtggacctacctatggaaagagtggttaacgtcggttgaccataaacgcctcggtatcatgtatatcatcgtcgcgattgtgatgctgttacgtggtttcgccgatgccatcatgatgcgtagccagcaggcgcttgcctccgcaggcgaagcgggttttctaccgccgcaccactacgatcagatctttaccgctcacggcgtaatcatgatcttcttcgtggcgatgcccttcgttatcggtctgatgaacctggtggttccgctgcagatcggcgcgcgcgacgttgctttccctttcctgaacaacctgagcttctggttcaccgttgtcggcgttattctggttaacctctcgctgggcgtgggtgaattcgcgcagacagggtggctggcttatccgccgctatcgggaatagagtacagtcccagcgtcggggtcgattactggatatgggcgttgcaactctcgggtattggtacgacgttaaccggtatcaacttcttcgtgacgatcctgaagatgcgtgcgccgggtatgacaatgttcaagatgccggtctttacctgggcctctttgtgcgccaacgtactgatcatcgcctctttcccgattctgacggttaccgtcgcgttgctgaccctggatcgctatctgggcacccatttctttaccaacgatatgggcggcaacatgatgatgtacatcaacctgatttgggcctggggccatccggaagtgtacattctgattctgccggtcttcggggtattctccgaaatcgcagcgaccttctcgcgtaaacgtctgttcggctatacctcgctggtttgggcgaccgtctgtattaccgtactgtcgtttatcgtttggctgcaccacttcttcacgatgggcgcgggcgcgaacgttaacgccttcttcggtatcaccaccatgattatcgccatcccgaccggggtgaagatcttcaactggttgttcaccatgtatcagggccgtatcgtcttccattccgcaatgatgtggaccatcggctttatcgtgaccttctcggtcggcggtatgaccggcgtgctgctggcggtaccgggcgcggacttcgtcctgcacaacagcctgttcctgattgcgcacttccataacgtgatcatcggcggcgtggtgtttggctgcttcgcaggtatgacttactggtggccgaaggcgtttggcttcaagctgaacgaaacctggggtaaacgcgccttctggttctggattatcggtttctttgtagcctttatgccgctgtacgtactgggcttcatgggcatgacccgtcgcctcagccagcaaattgatccgcagttccatacgatgctgatggttgccgccgccggcgccgcgctgattgcgctgggtatcctgtgccaactgattcagatcttcgtttctattcgcgaccgcgatcagaaccgcgatctgaccggcgacccatggggtggccgtacgctggagtggtcaacctcgtctccgccgccgttctataactttgccgttgtgccgcacgttcacgaacgtgacgccttctgggaaatgaaagaaaaaggcgaagcgtaccaacagcctggacagtatgaagagattcatatgccgaaaaatagcggtgccggtattgttatcgccgccttcgcgacggtatttggcttcgccatgatctggcatatctggtggctggcgatagtgggtttcgcaggcatgatcatcagctggattgtaaaaagctttgatgaagatgtggattactacgtgccggtcccggaagtcgaaaaactggaaaaccagcatttcgatgagattactaaggcagggctgaaaaatggcaactgatactttaacgcacgcgactgcccacgcgcacgaacacgggcaccatgacgcaggccagaacaaaatcttcggattttgggtctacctgatgagcgactgcattctgttctctattctgtttgctacctatgccgttctggtgaacggcaccgctggcggcccgacaggtaaggacattttcgaactgccgttcgttctggttgaaaccttcctgctgttatttagctccattacctacggcatggcggcgatcgccatgcacaagaacaacaagagccaggttatctcctggctggcgttgaccttcttgttcggtgccggatttatcgggatggaaatctatgaattccatcacctgattgttaacggtatgggcccggatcgcagcggcttcctgtctgcgttcttcgcgctggtcggcacgcacggtctgcacgtcacttccggtttgatctggatggcggtgctgatggtgcaagtcgcccgtcgcggtctgaccagcactaaccgtacccgcatcatgtgcctgagcctgttctggcacttcctggatgtgatttggatttgcgtattcactgttgtttatctgatgggggcgatgtaatgagtcattctaccgagagcggcggcgcatcccacggcagcgtaaaaacgtacatgaccggctttatcctgtcggtcatcctgacggttattccattctggatggtgatgaccggcgctgcctctccggccgttattctgggatctatcctggcaatggcagtggtgcagattttggtgcatctggtgtgtttcctgcacatgaacaccaaatctgatgaaggctggaacatgacggccttcatctttaccgtgctgatcatcgccatcctggttgtgggctccatctggattatgtggaacctcaactacaacatgatgatgcactaagagcggcgagtatgatgtttaagcaatacctgcaagtaacgaaaccaggcatcatctttggcaacctgatctcggtgatcgggggatttctgctggcctcaaagggcagcattgactatcccctgttcatctatacgctggtcggggtgtcactggttgtggcgtcgggttgtgtatttaacaactacatcgacagggatatcgacaggaagatggaaaggaccaagaatcgggtgctggtcaaaggcctgatttctcctggcgtctcgctggtatacgccaccctgctgggtattgctggctttatgctgctgtggtttggcgctaatcctttggcctgctggctgggggtgatgggcttcgtggtctacgttggcgtgtacagcttgtacatgaagcgtcactccgtctacggaacgctgattggttcgctctccggcgcagcgccgccggtgattggctactgcgccgtaacgggcgactttgacagcggcgcggcgattctgttggctattttcagcctctggcagatgccgcactcttacgccatcgccattttccgctttaaggactatcaggcggccaatatcccggttctgccggtgataaaaggaatctcagtcgctaaaaaccacatcacgctgtacatcattgcgtttgccgttgcaacgctaatgctaacgttgggcggttatgctggttacaaatacctggtggtcgccgcggcggtcagcgtttggtggctcggcatggcgctacgcggttacaaagtggaagatgataaggtctgggcgcgtaagctgttcggcttctctatcattgcgattaccgcactgagtatcatgatgtctgttgattttatggtgccgaattcgcagaatctgctgacttacgtctggtaaagactttagatggcgtatcgcttgatacgccatctttcttttcgcgtttaaataaaaattcccgccttaagaatgtccatctctttaccgttaacaatccccgtcacagcggttacgctatagctatcaacatcgcaaaattccggctgatagataggttgtaatgtcgattcacgtagcgtatcagacttatacccttgtaaattgcggttctgcatatttagcccaaaaggctcaaatgcgataacctgctgtgacatcgccccggccttatttttcagcgccagtgagacgcgtaaattctctatactgctgactctatccgttttgacgacaaactccagctcgcatgcatagccgctgccctgactcgcaccgaaaacacgatcacgattgaaggttaacttcggcaaattcttttcacgcattgccacagcctcagcacgggcctgtcggtctttttcgcaggtcacctgaaaatggggatcgtctgcaaaacttgttcgcccctgagcaaacaactccgctgccttccggcagtccgtgtcgacaaactgaccgttggtatacatccaggcaagatagtttaaagcgcgagacttgcccatcttcgccgcccgttcaaagaattcaaacgcccgagcgtaatcaagcggaacccgcgtcccggagtaatagatctcaccaagatttatgagcgcatcgacattaccctgcgcagccgccaactcgtaccactgcccccccttctgcagatcgcgcttaatccctcgttttccattcaagtagaagtaaccgagtatattctgcgcatcagcctggcccaattcagcagccttgcggaaccattgcaacgaacgcgcctctttatcgtcgacctcaacaaaaccagagtcatagagactaccaacgataaagttaagttcagggtctctctcctgcgcccacagctccgcaaggtgcaggatatccgcctttgaataacccaggcgcgtgatgcgcgcggccatcgcgctcccgccgccggcatactggcgtaatgtttcaataaaccgggaacgctgagtaatatcgctttccgcggcttgctttgccgtatctatttcgtcggctatcaggcgcgtcaccgtctgcgcatcagtatcgatatctgctttactggttttatccgcaagctcttttgccaaaacgtcatcctgcatcacccccaggccatgcagataaaaataacgagcgttgtagcagccatagggttattcaacatgacaagcctgctcataatacttgatagcctgtatcgtatctttcggcacggcaacgccgtactcataaataaaccccaactccgccagcgcttgagcattattatctttggctaacgcttttagctcatttagcgcctgaacatctttctgcgcaatacggctatataacgcgtcaatatcatcacctgcctggcataccgatgcgaaagaaaacccaagcagaagcaaaagattccatttccgctttatcatttttcattcccttattctttatctaaaaagtgcacactgtcagctttcagcaaatcgacattcttaccgttaatcgttgccgtagcggatttcagcgtaaaatggatatcgccgatcccgtgacaaaaatcttgcgtatacagtgggagatcgtatggggtaatgagaggatcaacatcatgattttgcatatctatccccagagtattcaaaccgaatggcggaatcatcaacgtttcctcagttgccattccatcagcatttttcagttcaagtgtaatatgcaaattcgccatgttacggattttatctgtgccaatctgaaaaattaatgcacattctttcggtttagccgttatcccgcgagagaaaacactctctttttttagggttactttgggtaaagcatccgcgttttttttcgactctgaatatccgctgcgcacttacttaaaaatattttttcctcaactttcttacctacatatcgagatgctttcttgtaatacgaccaggctttatcacaatcaggtgcagtacctaaaccgttataatacatccaactcaacggcatcgttgagcgcgaattagtaccatcattttcaacctgcgtaaataatgccagcgctttagcgtaatcagtgcgccctgttgcaccagaataatagattttacctaacgcaatctgtgcatcgctgtccccctgctcagacgcctgcccataccatttttgcgcttcctgaatgtctggcttaatcccccactcatcgccctctccccccgaataaataccccccaagagagattgggcctcaacgacgcctttttccgcggcggcgcgaaaccatttcaacgaggccggcctggctttataaggctcatccacataatggccagagaaatcattaagggtgagtaaccccagttgataatccatttgtggatcgccgtcctgcccccatagcgtagcaaggcggaacgttttttcctgattaaatccgatacgactaaaaaaagcgcatcgctctcgggtctattatttagagcatgaattagtatactaataaatgccgcccgctgcgatttatccatatcggccaatgctttcgccacgtaaatttcttgcgaaaacttgtcaatatattcttgctcaatcaataaattatccagattcatttttttagcatacttattggcctgagcgctatctttcgccactccgtcgccatgctgataagcatacttcacattatagcaaccgtagttaccgccaagctcacaggcctgcttataatactgcaacgcctgttcgcgattcatcggtacattaaggccgtattcatggataaaccccagttcatccagaaccgaagctcttttttccacaggcaaagcatcaaaatccttctgggtaagcgcagcgtattttacatcatctttactgttgttctctgatgcattcacctggttagcaaataaaacacctgctaaaatacataatgataagaatttaattttcacaactaattcactccttgaataatataataaataagactgatgactaaccttctgcctgataaacgcgcgccatcacgcagaaagtttgctatcagtctcggcgttgttgaataaatcaaattttcaggagatggacggttctgatcattgccatcgtttcagaatcgggtccctatggcaaagcaaaagtttaaagtcacccactggccagccacactcaggcagcgcggttcgctgacagtctgacttgacgagcctgctattgctatatgaagcaacagcgtacacagcctgaaggccgtggctaaccgctacactatactgagatggctcagatagccactacagctcaaggagatcggaatatgaatgagcacaaggctatgctgactctcccgatcgcccctatcgtgttaacaatttatctcttttttagctcaactgtttcaaaaacataatatttgctaattaaccctctatttacccggcacactccccgcactacactactcccagcttttatacagaggtggcaatgaacgattataaaatgacgccaggggagctgcgcgccacatggggtttagggaccgtcttttcgttgcgtatgctgggcatgtttatggttctaccagtactgaccacatacggtatggcgctacagggcgccagcgaagcattaatcggcattgcgatcggtatttacgggctggcgcaggctatctttcaaattccctttgggctgctgtccgaccgcattggccgtaaaccgctgattgtcggcggactggcggtatttgtcgcgggtagcgtcattgccgcgctctcccactctatctggggcattattctggggcgagcgctacaggggtccggcgctattgccgccgccgtcatggcgctcctgtctgatctgacccgagagcaaaaccgcaccaaagcgatggcgtttatcggcgtcagctttggtatcaccttcgcgattgcgatggtattagggccgattgttacccatagtctgggattgaacgcgttgttctggatgatcgccgccctcgccaccctgggcattcttctgacgatctgggtggttcccaacagtaccaaccatgtgctgaatcgcgaatccgggatggtcaaaggcagcttcagtaaagtgctggcggagccgaggctgctcaagctcaacttcggcatcatgtgtctgcatattttattgatgtccacctttgtcgccctgcccggccagcttgccgatgccggtttccctgccgccgaacactggaaggtgtatctggcaaccatggtgatcgcctttgccgccgtcgtgccttttatcatctatgctgaagtcaaacggcggatgaagcaggtattcctgttctgcgtggggctcattatcgtcgcagaaatcgtgttgtggggagcgggccagcatttctgggagctggtgattggcgtacaactctttttcctcgcctttaatctgatggaggcgctgctgccttcgcttattagcaaagagtcgcccgcggggtataaaggaacggcgatgggcgtctattctaccagtcagtttcttggcgtggcgcttggcggctcgctgggcggctggatagacggcacgtttgatgggcaaaccgttttccttgccggggccgtactggcgatggtatggctggcggtggcaagtaccatgaaagagccgccctatgtcagcagcctgcgtgtggaaattccagcggatatcgttgctgacgacaggctaaaacagcgactgttggcaatgaaaggcgtaagcgaagcgctgatcgtggcggaagagcattccgcttacgtcaaaatcgacagcaaagtgaccaatcgctttgaagttgaacagcttatcagcaaaggatgaatgcagcattgccggatggcggcgaggctctatccggcataacaacttaatcgcggaagtttttgaactggaacggctggcctaaatcgtcgccgcgaaccagcgccattaccgattgcagatcgtcacgtgatttgcccgtcacgcgaatctcttccccctgaatttgcgcctgcaccttcagtttgctgtctttaatcagcttgacgattttcttctgcacggcgctttcaatgccctgcttcagcttcgcttccacataccaggttttaccgctatgcacgaactcgtccggtacatccagcgaagcgccttcaataccgcgtttaagcagcttggcgcgcagaatatcgagcaactgattgacctggaaatcggactcgctcagcaccttgatggttttattggcatcgttcagttcaatagtcgcctctacgccacgaaagtcaaaacgagactcaacctcgcgaaccgcgttatccacgccgttacgcgcttcctgcagatcaacttcagaaacaatatcgaaagatggcatcttttcttctcccttcattttcgttgcgttgcataatacctgcaacgaggcttaacgagaagcttagctgatgacgctataattagcgccataacacctggcgctgttgcaggtgaggaggaacaatgaaaattactgtactgggatgcggagccttaggacaactttggctttcggcactgtgcaaacatggacatgacgtacagggctggctacgggtgccacaaccttattgcagcgtaaatctgatcgataccgatggttcctttttcaacgaatcactgacggcaaacgatccggattttttggcgaagagcgaactgttgttagtcacgctgaaagcgtggcaggtttccgacgcagtacgaaccctggcgtcaaccctaccggtgacgtcgcctatcctgctcattcataatggaatgggaaccatagaagaactgcaaagtatccaacagccgatgttgatggggactatcacccatgctgcgcgccgcgacggtaatatcattattcatgtcgctaacggtactacgcatattggcccggcgcgcgagcaagacggcgattacagttatctcgccgagatcctgcaaggggtactgcccgatgtcgcctggcataacaatatccgcgcagagatgtggcgcaaactggccgtcaactgtgttatcaacccgctcaccgcgctttggaactgcccgaacggcgagctgcgccatcatactgatgaaatcaacgcgatttgcgaagaggtcgccgccgtgattgaacgtgagggctaccacacatcggcagacgatttatgctattatgttgagcaagtgattgacagtacggcagaaaatatctcatccatgttgcaggacgtgcgcgccatgcgccataccgaaattgactacatcaccggttatttactcaagcgcgcccgcgtgcacggtctcgccgttccggaaaatagccgcctgtttgaaatggtaaagcgaaaggagagtgagtatgagcgctcaggcactggtatgcctcgcccctggtagtgaagagaccgaagcggtcaccactatcgatctgctggttcgcggcggaatccacgtcactaccgccagcgtcgccagcgatggcaacctgacgattgtctgctcgcgcggcgtgaagctgctggcggatgcgccgctggttgaagttgccgacggcgattatgacatcatcgtgttgcccggcggaattaaaggcgccgagtgctttcgcgacagcccgctgctggtcgaaaccgtaaaacagtttcaccgctccgggcgcattgtcgcagccatttgcgccgcagccgctacagtgctcgtgccgcacgatatcttccctatcggcaatatgaccggttttccggcgctgaaagataagatccccgccgaacagtggcaggataagcgtgtggtgtgggatgcgcgggtaaaattattaaccagccagggaccgggtaccgctatcgattttggcttgaaaatcatcgacctgttggttggtcgtgaaaaagcgcatgaagtggcttcgcaactggtgatggcggcggggatttataactactacgaataagaatgattgccggatggcggcgtaaacaccttatccggcctacaaaacggtacagtctgtaggccggataagcggcagcgccatccggcagttattttacgggcgttcgccctgcgccagacgcgcattaatatgcgcaatcacctcaggtaaatccgccagtgaatccaccacgtaatgcgccccggcggcgtacagcttgctggccgcgtgctcgcggcggaccgcaacgtcctctttcgacattgtctgataggcgtcccatgttgcgccgaattcgttacccgataccgccagccccaccgtccacatccccgcgttaagcccctcgctaatgcccggcgcggcatcatctaccttcacgcagtgcgcgaccgcatcaatgcccagcgcaatcacgttttgcagcgccatccacggccccgggcgaccacccgcgaccaggtcgtccgttgccacccaatgatccggacgataaccatgctcagcggcggcgggaaccaggcgctccatcaccgctcgtgggtaaccggagcaggagcctatcttgataccctcggctcgtagcgtcgcgatcgtgtcgataactccggcaataggagaagaaaaatcgacaactttagcaatctgtaacggcatgaaagcggcgtagatggcatcaatatctgctgcgctcatggcgcggccaaactttgcctgccagcgcgcgtcaacagtaggtaattttcccagcgcttcaatgtgttgccatttacccagccccattggcacgcgtgcttcggcgagggtgatctccacatcaaatgcctgacggaacgcctcgacgaaaatttgcgtcggcgcgaaggagccaaaatcgacggtggtgcccgcccagtcgagaataacagcgtgaatacggttcatcatggttccttatttcgtccagtacatggcggtacgaatggcggtcagcagggcagtgatatcggcggcatatacttcgccaatgttgccgatgcggaagcagtcgctttgcgacaccttgcctggatagataacaaagccctgctctttgaggcggcgataaaattcgctaaagcgatactgcgggtcttccggtgaataaaaggcggtgataatgggcgaatgaagctcgtcatccagcagcgtgttaaagcccagcgcccgcattccggccaccaggctgcgctgattttgctgatagcgttgatgacgtgccgccacgccaccttctttcgccagctctttcagcgcctgtgcaaacgccaggacggtatgtgtgggcgaagtaaaacgccatttgccgtggttatcctccatgcagcgccactgggcgtagagatctaacgacagcgagcgggaacgccctttgcacgcggccagtttttgctcgcgggcaatcacaaaggcaaaacccggcacgccctggatgcatttattagcggagctgatcagatagtcgatgtgtaatgctgcaatatccatggggatgccgccgaagctgctcatggcgtcaacgatgtaggttttgccatagcgatgcgccagagcgccaacctcatcaatggggttgagcatcccggtggtcgtttcgctatgcaccatggcgatatggctgatcgtcgggtcggcgttgaggatcgcgtcgatcgcctgcacgttcgggcgcgcaacttcgccgcagtcgtaagcgtgatgggcgatacccataaggccggccatctcgaccattcgtgcgccgtatgcaccgttgctgacgatcagcaccttatcctgcggccccaatgcgcttcccagtacggcttccacagcatagctgccgctgccttgcagcagtacggaggtgtagccttcggaggccgttgccagtgcggtcaactgctggcggatctgttctaccacgccgatattgtaatcatcatcccaggtacagctatcgaacaacatcgcttctttcacggtgcgagaggtggtgagtgggccaggggtcagcaacagatagttacgcgaagtcatatcatttacctttggtctataccagattgcatttatcatgacgatctttgccgcgatgggtcaaagagaaaatcgcgctgcaacaaaaaattcatctctgcttgtataatggcggcaggtaaaacggaagcgagtaagcatgaaatctatcccgggcgatatcccgcagtacctgttgatcaaggcgcagcttcaggcgcgtattcagagcggtgcgttgaaaagcggtgataaactgccgtctgaacgcgaactgtgcgcgatcttcaacaccacgcgcattactattcgcgaaagcctggcgcagctggagtccagtgggcttatctggcgcgccgatcgtcgcggttggttcgttacgccggaacgcctgtggctggatccgacccagaacaccaacttccataagctttgccgcgagcaggggcgggagccaaaaaccgcgctactgagcggcgtgttaaccaccgtgcctgtcgaggtcatggagcccctccagctccagccgtttgatcaaatctatctgctgacccgtctgcgttacgccgatggccgcgccgtgtgctactgcgaaaaccattgtttgcccgcccgcgtgcctgagctgctgcagtacgatctcaacggcagcctgaccgaggtatacgagtcgcactacaacctcgtctataccagcatgcatctgtcgttctaccccaccgccatgcctgcgcaggccgcacaggcgctgggagttatggaaggacgcccggcgctgttgctgcgccgtctgaactacgatcaacacgggcgagtgctggatctggatatcgaatactggcgtcacgacagcctgcgcattgaggtagatacccactagcgggtgcgccggatgttggctgcgggccttatccggcctgtcaatcgtatcgtctcacggctatcccgataagcgcagcatcatccggcgtggactgatttatttctctttcatcgttttgtcatataagccgtttagcgtaaaaagcaaacctggtataggccagaaaatgcaacgtacgctatgaggctattacgatgaaactttcccgacttgctctgctgtctgtcttcgctctcgccagcgccccgtcatgggcggaatcagtggtcacggtgtactccatcgacgggctgcacgatggcgataacagctggtaccaggtgcagtttgacgcgttcaccaaagcgaccggcattaccatacgctatgttgaaggcggtggtggcgtggtagtggaacgtctggcaaaagagcgtacgaatccacaggccgacgtgctggtaaccgcgccgccattcattcagcgcgccgccgccgaaaagctgctggcgaactttaacaccgacgccgcctcggctatccccgatgccaacaacctttattcgccgctggtaaagaattatctgagctttatctacaacagcaagctgctgaaaactgccccggcgagctggcaggatctgcttgacggtaaattcaaaaataaactccagtattccacgccaggtcaggccgctgacggcacggcggtaatgctgcaggctttccacagcttcggcagtaaagatgccagttttgcgtatctcggcaagctgcaggccaataacgtcgggccatctgcctctaccggcaagctaaccgcgctggttaataaaggtgaaatctacgtcgctaacggcgacctgcaaatgaacctcgcgcagatggaacgtaacccgaacgtgaaaatcttctggccggccaacgacaaaggcgagcgcagcgcgctggccatcccttatgtcattggcctggtccagggggcgccgcagagtgaaaatggtaaaaagctgattaacttcctgctgagtaaagaagcgcagactcgcgtcagcgaactctcctggggaatgccggtacgcagcgacgtgacgccgagcgacgaacattacaaggccgccactgccgcgttagaaggcgtgcagagctggcagccaaattgggatgacgtagccgtttcgctgtcggcagatattagccgttggcacaaagtgaccgaaagcgagtaagcctgatgctgatgaaaacgactgccgttcacgcccctgcatcgcaggggacatcggggatagtcctcgactcgctgcgtgttgcgtatcacggcaacgtggtgcttaaaccgctctctttgacgattgaacctggcgaagtgctggcgctgattggcccatcaggatctggaaaaacgacggtgctgcgtgcggtggcgggctttgtgcagcctgcaggcggtcgtatcctgattggcgatacggacgtcacccatctgccaccctataaacgcgggttggcgatggtggtgcagaactacgccttgttcccgcatctgaaagtggaagacaacgtcgcttttggtctgcgtgcgcagaagcagccaaaggcgctaattaatgagcgtgtcacgcaggcgctgaagacagttggcatgagtgattacgccacccgttatccgcatcaactttctggcggccagcagcaacgcgtggccatcgcccgcgcgattgccgtgcgcccgcgcgtgctgttgctggatgaaccactgtcagcgctggacgcacagattcgtcataatatggtggaagaaatcgcccgtcttcaccgtgagctgccggaactcactattctctacgtcacccacgatcaaacggaagcgctcaccctggccgataaaatcggcattatgaaggatggctcgctgattgctcacggcgaaacccgcgcgttatatcaccatccgcccaatcgttttgccgccgaattcttaggtcgcgccaatattctctccgccatcgcgctggggataacggaggttccggggctggtggacgtcagctgcggcggtgcggtgattcgcgcgttcagccagggcagccaccacggttacaacaaactgctgtgcattcgtcctcagcacctcagcctaacgccgcgttcggcctacagcaaccgcttcaacgccacactgcaatcggtgcactggcaaggcgatttaacccatctgttgtgtgacgttgctggcgaaacggtgcggatggtgttgacgcatgtcaatccgctgccgcgcgtgggcgacaagctggcgctgtggttcgaaccggatgatgcggtcctgattgaggtataaccatgtcactcattttacctctggaaaaaccggcgcttaacctacgcccgctgctgtggctgttgctcccgttgctggcgctggcgacgctgtttttctggcctctgtcgctcatcgttgaacaggcgctacgcggtgccaatggcgagatcgggctcgagaccttccgccaggtggtcgactcgaaacgctttgtcggcgcgttgctgaacacgttgcaaatcgcctttttcgccaccgccggttgcctgctgctgggcagcgtgatgtcgctgattctggtgtttattcctttccccggcagcgagttgattggtcgggtcgtcgatacttttattgcgctgccgaccttcctgattacgctggcgttcacctttatttatgggtcagcgggtctgctcaacggtgcgctgatgagcctgtttgcctttgagctaccgccggtggattttctctactcgatgcagggtgtcattctggcggagatcacggtgttcactccgctggtgatgcggccactgatggccgcgctgcggcaaattgataaaagccagctagaggcagccagcattctgggggcacacccgttacgggtgattgggcaggtgattttcccggcggcgctaccggcgctgatggctagtggcagcctgtgcctgctgttgaccactaacgagttcggcatcgtactgtttattggcgcgaaaggggttaacaccctgccgatgatggtttacagcaaagcgattctggagtccgactatacggtcgcctgcatgattgcgttgattaacattgtcttgtcgctggggctgttctccctctatcgcctggcggcatcgcgtaccggcgtaaggagccagccatgctaatttggtcacctaaaggacgcgcagcggcgggcgttgtggctagcgtactgtttatcgtgttctttttcctgccgctggcggtgattctgatgtccagccttagccagcggtggaacggtattctgccgagtggcttcacgctgaaccactttgttaacgctctgcacggtgcggcatgggatgccctacttgccagcctcacgattggcttttgcgccagcctgtttgcgctgctttgcggcgtttgggcggcgctggcgttgcgtcaatatggggtgaaaacgcagaaatggttaagtatggtgttctatctgccgagtgcgattccgtcagtgtccgtgggcctgggcattctggttgctttcagccaggggccattgcaaatgaacggcaccctatggattgtgctgacagcgcactttgtgctgatttccgcctttaccttcagtaacgtgtcgaccggactggcgcgcatttccgccgatattgaaaacgtcgcgtcgagtctgggggcatcgccctggtatcgtctgcgtcacgtgacgttgccgttattgatgccgtggatggtgtcagagctggcgctgagtttatcgctctccatgggggagttgggcgcgacggtgatgatttatccaccgggctggacgacgctgccggtagctatctttagcctgaccgaccgtggaaatatcgccgacggcgcggcgctgaccattgtgctggtggccattacgctgctgctgatgatgaagctggagcgcattgcaaaacggttggggtagaaataaaacggtaggccgggtaggacatagccgccacccggcaaaggaattacgggcgatacaccttcacattggcaaacccctgctcgcgcagatagagcgcctgcaggcgactcattacgccgcgttcgcaccatagcagccaggttttgctctgatcgaggtcgccaaatttagtgctcagcttgtagaaaggcagcgaaacgacgtcgacgccttccactttcagcggcttgtcatcctgctcatcgacagaacggatatccagaatcacatcgttggcgccaaaaccgctcacggtttcaacttccaccacctcctgctgggtctgctgggcgatttcacgaatatcgacgttgttcgcttcttctaccaccttatcgagaatactgaagtcgaaattttcttcttcggcttcaattttcgctttaatggctttcaccgtcggactttttgaaatcacgccacagtattccggcatcgtacgggcaaaatcttccgtaccaatctggcgcgccaggttgataatgtgctctttatcgtaagagatcagcgggcgcaggatcagcgtgtcagacacgttatcgatcaagcgcaagttggttagcgtctggctggacacctggcccagcgcttcgccggtcaccagcgcctgtacgccgtaacgttccgccactttcgacgccgcgcgtaccatcatacgtttgagcaccacgcccatctggccgtcgtcgactttctccagaatctcgccgaccactggttcaaagttaatcgccacaaaacgcacgcgatgggagctgccaaagcggttccacaggtaatgcgccacctggcgaacgccgatttcatgcgccgcgccgccgaggttaaagaagcagtagtgtacgcgacagccgcgacgcatcagcatatagctggagacgctggagtcaaaaccgccggagatcagcgacagcacgtcttcctgggtgccaatcgggaaaccgccaataccttcataacgccctttgatcagcagcaggcgatcatcttccacttccagatgcaccgtcacatccgggttagtgagcttcacgcgcgctgattcaatatgctgatttaatccgccgccaacatagcgctccacttcaatggagctaaactcatgcttaccgcgacgttttacccgcacgcagaaggttttgccttcaagctgttcgcgatactgcgccaacgctttctcgaaaatgtcgtgcatatcggtgaacggcacatcttcgacttcaagaatatggtgaatccccgggatgcgggtcagcgcgtcgcgaatcgccagacgctggttttcatctttggcgcgaacttcaatgttatcccagtgacggacaaccgcgagggtctcatcgtagtgctttaaaacgttacggatgttcccggttaaaatttttataaagcgcaaacgcacagattggcttttgatagtgatttccgggaacaatttaatgataaacttcatggcggtaatggttctttagcaagctatctaaggcttgtcgtggagaaatagtacagcagcccatacctacggctgcatccaggcgcggaagtatatcaccatcacggacatcttgcgcatttccccttaccattgcgcgttatttgcttatcagtgcgagtccgttaccatagacttgtgctgccattacagagagtcaaacagtcatcatgccgaagaaaaatgaggcgcccgccagctttgaaactgcgctgagcgagctggaacatattgttacccgcctggaaagcggcgatttgccgctggaagacgcgctgaatgaattcgagcgcggcgtacaactggcgcgtcaggggcaggcaaaactgcagcaggcggaacagcgcgtgcaaattttgctgtctgataatgaagaggcttcacctgagccttttatcgcggataatgagtaaatggactttacgcagcagctacaggcttgcgtaacgcaagcgaatcaggcgctgagccgttttatcgcgccactgccctttcagaacactcccgtggtcgaagccatgcagtatggcgcattattaggcggtaaacgcctgcggccatttctggtttacgccaccggtcaaatgtttggcgtcagtacggcaacgctggatgcgccagctgcggcggtcgaatgcattcatgcctattcgctgatccatgacgacctgccagcaatggacgatgacgatttgcgtcgcggcctgccgacttgccatattaaatttggcgaagccaacgcaatcctggcgggagacgcgttgcaaacgctggcgtttaccattatcagcgacgcgccgatgccggaagtcgccgatcgcgatcgtatcgcgatgatcgccgaactggcaaacgccagcggtatcgccggtatgtgcggcggtcaggcattggatctggcggcagaaggccagcggatcactctggacgcgctggaacgcattcatcgccataagaccggcgcgctcattcgcgccgccgttagacttggcgcgttgagcgcgggcgataaaggacggaatactctgccgatacttgaccgctatgcagagagtatcggccttgccttccaggttcaggatgacattctggatgtggtgggcgatactgcaacgttaggtaaacgtcagggcgcagaccagcagcttggcaaaagtacctaccctgcacttctgggtcttgagcaagcccggaataaagcccgggacctgatagaggacgcccgtcagtcgttacatcagctggccgcgcaatcactggacacctcggcactggaagcgctagcgaactacataatccagcgtgataaataaaccccatatccaatgagcttgcgatgagttttgatatagccaaataccctaccctggcattggtcgactccacccaggagttacgactgttaccgaaagagagtctgccgaaactctgcgacgagctacgccgctacttactcgacagcgtaagccgttccagcgggcatttcgcttccgggctgggcacggtagaacttaccgtggcgctgcattatgtctacaacaccccgtttgaccagctaatctgggatgttggacaccaggcttatccacataaaatccttaccggtcgtcgcgacaaaatcggcaccattcgccagaaaggcggtctgcacccgttcccgtggcgcggagaaagcgaatacgatgtgctgagcgttgggcattcctccacctccatcagcgccggtatcggtattgccgtggcggcggagaaagaaggcaaagatcgccgcaccgtctgtgtgattggcgacggcgccatcaccgccggtatggcgtttgaagcaatgaatcacgcaggcgatatccgacccgacatgctggtcattctgaacgacaatgaaatgtcgatttcggaaaacgtcggcgcgctcaacaaccatctggcgcggctactttccggtaagctttactcttctctgcgcgaaggcggaaaaaaagtcttctccggcgtaccgccaattaaagaactgctcaagcgtaccgaagaacatattaaaggcatggttgtgccgggaacactgttcgaagagctgggctttaactacatcgggccggtcgatggtcacgatgtcatggggcttatcagcacattgaagaacatgcgtgacctgaaagggccgcagttcctgcatatcatgaccaaaaaaggccgcggctatgagcccgcggaaaaagatccgatcactttccatgcggtgcctaaatttgatccctccagcggatgtttgccgaaaagcagcggcggtctgccaggttattcaaaaatcttcggtgactggctgtgtgaaaccgccgccaaagacagcaagctgatggcgatcaccccggcaatgcgcgaaggttccggcatggtggaattttcacgtaaattcccggatcgctattttgacgtcgctatcgccgagcagcatgccgtcaccttcgccgcaggtctggcgattggcggctataagcccgtcgtggcgatctactctactttcctgcaacgcgcctacgatcaggtcatccatgacgtcgctatccagaaactgccggtcatgttcgccatcgatcgcgccggtatcgttggcgcggatgggcaaacacaccaaggcgcgttcgatctctcctatctgcgctgcatcccggatatggtgatcatgacgccaagcgacgagaacgaatgtcgccagatgttatttaccgggtatcactataacgacggcccgacggcagtacgttatccacgcggtaatgcgcagggcgtggcgctaaccccgctggaaaaactgcctattggtaaaggtcttgtgaagcgtcatggcgaaaaactggcgattctgaactttggcaccttaatgcctgaggcggcgaaagtcgccgaagcgctgaatgccacgctggtcgacatgcgctttgttaaaccgctggacgacacgttaattctggagatggccgcgcagcatgacgcgctggtgacgctggaagaaaacgccattatgggcggcgctggcagcggcgtaaacgaagtgctaatggcccatcgtaaacctgtacctgtgctgaatatcggtcttccggatttctttatcccgcaaggaacgcaggaagaagcccgcgcggaactggggcttgacgccgcaggcattgaagccaaaatcaaggcctggctggcataatctcctctttgctcctgctatgcttgaagagtgacgggtataacaggagcggagtcatgcaatacaacacgttaggaaataccgatcttcgggtgtcccgcctttgtctgggctgtatgacattcggcgagccgagtcgcggcaatcacgcctggacgcttcccgaagagagcagccgtcccatcatcaagcgcgcccttgagggcggcattaacttttttgataccgccaacagctactccgacggcagcagcgaagagattgtcggtcgcgcgctgcgtgattttgcccggcgcgacgaggtggtggtagcgacgaaagtcttccatcgcgtcggcgatctgccggaaggattgtcccgcgcgcaaatcctgcgctctattgacgatagcctcacccgtctgggaatggagtatgtcgatatcctgcaaatccaccgctgggattacaccacgccgatagaagaaactctggaagcgctaaacgacgtggtaaaggcgggtaaagcccgctatatcggcgcttcctcaatgcacgcctcacaatttgcccaggcgctggcgctacaaaaacaacacggctgggcgccgtttgtcactatgcaggatcactataacctgatctaccgcgaggaagagcgtgagatgctaccgctgtgctggcaggaaggggtcgccgtgattccgtggagtccgctggcgcgcgggcgcttaactcgcccctggggagaaaccacggcccggctggcctcggatgacgtgggcaaaaatttatacgatgaaagcgataaaaatgatgcgcaaatagcggaacggctggctggcgtcagcgaggcgcttggcgcaacgcgagcgcaggttgcgctggcctggctgctcagcaaacgaggcgtcgccgcgccgattatcggcgcttcgcgtgaagagcagttagatgagttgctgaatgccgttgatttaacgctcaaaccggagcagattgccgaactcgaaacaccgtacaagcagcatccggtggtgggatttaaataatctgccattgcccgatggcgcggcgcttatcgggcctgcgaaatcgacatattgttcggaggcaggccggataaggcgtttatgccgccatccggcaaaccctttaaataataccgagcggccagtgatgaccgataaaatacagtatgccagcggatatcaccccggcgacgatatcatcgatcattatccccatgccgccgtgcacgttgcgatcaaaccaacggatcggccagggtttccacatatctagaatgcggaaaataacgaacccggcagccacccattgccagtccgtcgtcggcaacgccattagcgttatccacataccgataaattcatcccagacaatactgccgtggtcgtgtacgcccatatctttcgccgtctgatggcaaagataaacgccaatgcagattccaaacatcacgaccagcgaataaagctgccacggcagaaacgtcatcagataccagaaggggatcgccgccagagagcccatcgtacccggcaccacggggctcagcccgctgccaaagccggtagcgagcagatgccacggattgcgcaaattcaggcgacttttcgcaacatctttatggcgtggcaaaatggtcatatcctttccagtcgaaggtgacaggcattccgtcacgtacaaaattcagcccttcaatatctgcgctcatttggcctatgcaggtaaagggaacacccagttgaccaatggcgacatccagcgcgccacggttcagttccggcaccgtaaagcacaactcatagtcttcgccgccggaaagcgcccaacgcagctcctgcccgtcatcaacatggcgcatcatcgcatcggattttggcaacgcatcaacatccactcttgccccacagccgctggccttgacgatatgccccagatcggaaatcagaccatcggaaagatcgatagccgcgctggcgatgtcacgcagcgcctggccgtgtaaaatacgcggcgtcgggcgtaaatgccgttgaattaaatagtgagcatcggtctcctccgacacctgtagccggttttgcaaaaccgccagcccggcagcgctgtcgcccggcgtaccggtgacataaatccagtcgcccggcttcgcgccagatcgcttgagcgcgcgccctgccgggatataaccgtggatacccagcgtcatcgacagcggtccacgcgtggtgtcgccgccaatgagctgcatatcgtagtaattcaatagcgcaaacaggctgtcgctaaaagcctccagccacggctcatccacttccggtagcgttaacgccagcgttaaccaggccgggtcggcccccatcgcggccagatcgcttaaattcaccgccaacgctttataagccagatcggcaggatcgatatcagggaggaagtggttgcccgccaccagcgtatcggtactgatcgccagggtctgcttttcaggaatattcaggagcgcgcaatcgtcgccaataccggtttcaacatcaagacgagagcttcttacacggtcaaaataacgggcaatcagggaaaactcgccacatgccatacgttatgcctcagcagaaaaaaagaaaaggccggagacggcgggtatcgatcgcccgctatctttccggcctgtgaatcactttttgttgggacgaatcaccggagctgctttatccagtacgccgttgacgaatttgtggctgtcttcagcgccaaaggttttcgccagttcaatcgcttcgttgatggccactttataaggcacatcgctgcgttttgacagctcaaacaacgcaatacgcagcacggctttttcaacctgtcccagctcttcaagcaggcgggacagatacggtttcattaaaccatccaggtacgcgctgttagtcgccaccccggatagcagttcacggaaatagagaacgtcgacgtcttttacgtcctgttccgccaggaactggtattcaacatcagcgatgtcgttctgggacaactgccaggagtaaagcgcctggacggcacactcacgggcgcggtgacgagcagcaggtttcacggaattccccttacaaaaaatcaggccttaatggctttcaatacattaatcatttcaagcgcggtcagcgcagcttctgcgcctttattaccggcttttgtaccagcacgttcgatggcttgttcaatactctcggtggtcagaacaccaaaggctaccggcacgccgctgtcctgggcaacgcttgccaggccattgctggcgccgcctgccacatattcaaagtgcgcagtccccccgcgaatcacggttcccagcgcaaccacggcgtcgtatttaccgcttttcgccagcgcttcggtcgccagcggcagttcataagcgccaggcacccacactacggtaatattatcatcttttacctgaccaatacgcgtcagggcatcaaccgcgccatccagcaggctgtcgttgataaactgattgaaacgcgcaatagtgatggcgacacgagcgtcaggggctgcaacgttagctttaataatgttcatattctctcttccagggttcatttggccccgcaggggggcggattttatcataataatttgagcgctgctcccctttcgacgggagaactcatgcgctcaccatatgcaggcaaacatccgggccgacatgacgtatttcgctgaaggtaaattgcggcgcgtcggcgagcttctcaagccccggcaattcgcataatccccgcgcctgggttcccaacaatttaggcgcgacatagacaatcagttcatccaccagcccggcttgcagcaacgcgcccgccagtcccggtccggcctcaacccatatgctattaatctgctgcctgcctaactgcatcatcagcacaaccagatccaaatgtccgttgtgcgccggcacgctgatagtacgaaccgaatcgggccacgcgtggctatcttcctgggtacgcgcaatccacgtttcgccaggctgctgcacaatacgatgcgcaggcgttacccggttttggctgtcgataacaattcgcaccggctggcgcagattttcctgcgggtaagacgcctgtgtagaggcgtctaactccgcccaacgcaccgtcaaggccggatcgtcagccaataccgtcgcgctactggttaaaatagcgtggctttgcgcacgcaagcgctgaacgtcgcgccgggcctgcggcgaggtgatccactggctttcgccgctggccatcgccgtccgtccatccacggaggcacccagtttaagctgaagataagggaatccggtacgcatccgtttgaggaagcctttattgagcgcctccgcttcactcatcattaacccgtggctgaccgcaatacccgcctgttgcaggcgatacagcccgcgcccggcgacctgtgggttcgggtcctgcatcgcggcgaccacgcgcgcgacgccagccgcaatcagcgcatcgcaacatggcggcgttcgcccatgatggctacagggttcaagcgtgacataggcggttgcgcctttggcttttgcgcccgccatccgcagcgcatggacctcggcgtgcggctctccggcgcgatggtgataaccttcgccgacgatgtcgccattgttaacaatgacacagccgacattagggttcgggtgagtggtgaaacgtccacgctgcgccagtttgagcgctcgcgccatgtaaaactcatcctgcatggcttagtcctgtaggcgagcgatttcttcgccaaagtctttgatatcttcgaaactgcgatagacggaggcaaagcgaatatacgcgactttatcgagttttttcagctgctccatgaccaggttgccaatcatcttgctgggaacttcacgctccccagtggcacgtaattgtgacttaatatggttcaatgccatttcaacatcatctgcgctgacgggtcttttttccagcgctctcaacatgccgctacgcagcttatcctcattaaagggttcgcgcacatcgttgctttttatcacgcgcggcatgaccagttcagccacttcaaaggtcgtaaagcgttcattacacaccagacactgccgacggcggcgcacggacgagccctcgcctacaagacgagagtcaatgactttggtatctacggcgaaacaaaatgggcaatgcatacggcgtcctgaccagatgatttaggaaatgctattttaccctgaactggcgcgacaacaaaggcggagcgcttttgagataaaggatcggtgcctttgtgcgtatagcgcactaccattacgctatcggaccacgaaggaaatgatcgacatgacaagacgttacctaagaattctcctggtgggaagtctcttgagcctgaccgcctgcgcgccgcagagcgaagttcgccagatgcatcaaagcattagcaccctgaataaagagatgacccaactgaatcaggaaacggtaaaaattacccaacaaaataagctgaatgcggattcaacccgcggcgtctatttgttgcctggcgccaatacgcctgcccggctggagagtcagatcggtacgctacgtatgacattgctggaaattacgcctgtcgctgacggcgctcacgcaacgttacgcattcagggcaagtcccgcgatccgctaccggcattcagcgctaccgtagagtacgggcaaattcagggcactacggagaactatcaggaggtgaatgcgcagagccttctggtaaatgcgcccgccagcttgctggcgcccagtgatgtcaatattccgttaccgttgaaggggatcacaccggcgcagttaggcttcattcgcatccatgatattcagcctgttaatcaataaacgttctggcggagcgttttgtgcgctccgcaacatcctctgcgcaacttttgttgcccttctgacatttccgtaatttatgacacggattgttaatattcatgaaagatagtactgtcgccgcgcctaaagtgcgcaaacgtgaacgcaatcgattacgtaaatgatagatatgtgaaacaagacatatttttgtgagcaatgatttttataataggctccgcagaaacacgaaatatttagaaacgcaaattgcgttcttttcactcccgcaagggatttcaaacagtggcatacatatgaaaaaaactttactcgcagtcagcgcagcgctggcgctcacctcatcttttactgctaacgcagcagaaaatgatcagccgcagtatttgtccgactggtggcaccagagcgtaaacgtggtaggcagctaccatacccgtttctcgccgaaattgaacaacgacgtctatctggaatatgaagcatttgccaaaaaagactggtttgatttctacggctatatcgatattcccaaaacctttgattggggtaacggcaacgataaaggtatctggtccgacggttctccgctgttcatggaaatcgaaccgcgtttctcgattgataagctgaccggcgcagacctgagctttggcccgtttaaagagtggtatttcgccaacaactacatctacgatatgggcgataacaaagccagccgccagagcacatggtatatgggtctggggaccgatatcgacaccggcctgccgatgggtctgtcgctgaacgtgtatgcgaaatatcagtggcaaaactacggcgcgtccaatgaaaacgaatgggacggctaccgtttcaaagtgaaatacttcgtccccatcaccgatctgtggggcggtaaactgagctatatcggctttaccaactttgactggggatctgatttaggcgacgatccgaaccgtaccagcaactccatcgcttccagccatatcctggcgctgaactacgatcactggcactactcggtcgttgcgcgttacttccataacggcggacagtggcagaatggcgccaaactgaactggggcgacggcgatttcagcgcgaaatctaccggctggggcggttacctggtcgtgggttacaacttctaaacctgcaaaaaagccagaggtcgtcctctggcccgtttcgggcgcatgctgccatgcggcggcgagtcgcgcccacttcacattacttccggcgatgccaccagcctaaaaacagacctgtcgcaatcccgaccagcgttggtgccgccagatcgtgccagatagtaatgctcaactctgtgagcgtcatattgccgcctttgttgcaatggcaacggttcgcggctatcctcaacttgtctggggtcaagttagcccccgtaatgttgccggtgaataccgaacaatgtgcgggggttttctctttccagcgacaaggccaccggggatcaagcccccgcaacattgcgcctcaccgggttgccccggcttaccgctgattctactctgctcgccagtatcggcaggacttaaaaacaaaaaaatcccaaccttgcgatcggaattccagtgacaatgtatgcgttacaggacgtttggggctggcgacaaactccggggctgaaaaaatgtcagattgcatccgacctacgaaaaccaataattcatttatattgcggattccgttgggtggagtggagcgaagcgtaacctaacattcaacagcaccaacagctttgtcagcagtctgcttatttctttttgttcatcatcgctttcagatcggcaaacgggttataagtcgcctcgccgacatctttttgcgcatcttccccggcaatgaccgtcgaaccgtactgatcggcttcggtatatttagaatgctcatgatcgtggcagtagaggcacaatagctcccagttactgccgtcttccgggttattggtgtggtcatgatcgatatgatgcaccgtcagctcacgcagatttgaatacacaaactcacgggaacaacgtccgcacacccacggaaacagcttcagcgctttttcacgatagccgctttccaggcgcgcgtagttttttgggatgatagccataattaacaggtacctgaataatacaaagggttatgcgcagtttcccgcgaagccgggcttttagcaatgattctgtgcaacttatatatccaggtaaggaaggctatttcaggcaaactgatgaccaatcaacccgttttacaagcgttggaggtatcgctatcacatcttacggcattttttcgtgctcgactttacgcaaaaaatcacgcaaagaacggtcgattgtttcacgaaatcgccggttaagcggagtaatttgtaaacagcgatcgaggcgaaaacaccgatagtcttcccgtctctcacaccaggcaaccagtagccagtgctctccccagaaaaacaatcccagaggttgtatatcccgcgaagagagatgccccgcttcatcacgataatgtagcgccaacacctgctgcgccgaaacagcctgatggataagatcaaacgcgctgcgcgaatgtggagatgtacccaaatccggagcgtaaatccgtgtctgctccgctttacgacggctctcttccggtaaaatagccaacactttttcctgggcggattcaagctcgcgcgatagcgaatcgccaccccaggttttcaataaccgtatagccaccatcagtgcttccgattcacgatgggtaagcatcaagggcggcagatcaaaacccgccattaaacggtatccgctccccgcttcaccttcgacaggcacaccggataacgacagatcgcgaatatcgcgataaatcgtccgttcagaaaccgcaagccgctgtgccaacagcgctgccgtcgtcagtcgtctaccccgcaaaatttgcacgatctgaaacaaacggtcagcgcgtctggtcatattgactctctacatttagcaaatatcacgcaggttgatgtaaacctattcggttaccttcgctgtcaataaacaacgcgatggttccaatgtcatctccgggaaccatgggttccagaacacacttgccaccggcaaggacgacacgttcaatcgaggctaacaaatcggcggtatgcagataaataacgactccctgcgcaactggagcgacatcatcctgctttatcagcgctccgccgggtccgggttcagcatacgggaatacggccaggtccgccccatccatggtttcccgacgtaacgatatctgcatcacttgctcataaaaggcgattgcacgcgccatatcagtaactggaatttcaaaccagttaatcaagtttttcatacatcctcctgcgagtgtgggtaaattcatgaggagtgtatgacagggctcctgacagcatactgtcagtaatgtttatcgtcatggtacataaataaaaaatcccgatcgcatgaccgggattcagataacacttaaatacgtgtttacggcagaatggacggctgatccgccccttctttttcgactttctgctgcagcatatgctcgcgcttcataccgagtttcagcgccagcgccgatgcgacatagatagaagatgccgtaccaatagagacaccgatcagcatcgtcagcgagaagccttccagtaccggaccgccgaagaggtacagcatcagaattaccactaacgtcgtaccggaggtaatcaacgtacggtgtagcgtctgggtcagcgacacgttaaagatttcgtaaggcgtcccgcgacggattttgcggaagttttcacgaatacggtcggagaccacgatactgtcgttcagcgagtaaccgatcaccgacatcaacgatgccacaatggtcaggtcaatctcaatatggaaaagcgacagtatccccagcgtaatgatcacgtcgtgcgccagcgcgatgaccacccctgccgccagtcgccactcaaagcggaaaccgacataaacgaggatagagatcaacgccaccagcagcgccatggcgccggtttgcgccagatcggcgcccacgcttggccccacgaattcaatacgcttcacggccgcgttctggttggtggcttcattaatgatcgtcaccactttgctacccagtacctgaccgccggtttcaccttcggttggcggcatacgcaccataatgtcgtgactgctgccaaagttctgcaactgcggctcttcatagcccgctttttgcagcgcttcgcgcatcacgtccatttcagccggtttttccagcgtgatttcaattaccgtaccaccggtgaaatccagcccccagttaaacccgcgtacgcccataatgacaatggccgcgatcagcaacagcccggagatgccgaatgcccagaagtcccagcgcataaagtcatagactttacggccgtggtttagttgttcaacagtgtattcctgtgccacatcgcactcctcagattgacagcttagtgacgcgcttgccgccatatagcaggtttacgatagcacgcgtaccgataatcgcggtaaacatcgacgtcgccacaccgataccggtcgtaatcgcgaaccctttaattgccccggtaccgacagcatacagaatgatgactttaatcagcgtcgtgatgttcgcatcgaagatggaactgaacgcgccggcatagccttcgtttatcgcctgctgtaccgtgcggccattactcaactcttctttgatacgttcgttaatcagaacgttggcgtcgaccgccaccgcaagggttaacacgatacccgcaatccccggcatactgagcgttgcccccggcaacagcgacatgataccgacaatcaacaccaggttagccactaacgcgctggtcgcaatcagaccaaacttcttatagaagaagatcatgaacaggatggagaccaccagaccggccagacaggcttccaggccctgcttgatgttctgcatacccagagtcgggccaatggtgcgctcttcaacgatctgaatcggcgcaatcagggcacccgcacgcagcaacaacgagagctgacgcgcttcgttcgggttgctgataccggtaatacggaagctgttacccagccgagactggatgttggcaatgttaatcacctcttcctgtttcaccagtacggcgcgaccgttagcgtctttcttaccgctgtctttatactccacaaacagggtcgccatcggtttgccgatattgtccttagtgaagttagacatgatattgccgcctgcgctatccagcgagatgttaacctgcggttggttatattcatcctggctggacgtcgagtcggtgatatggtcgccggtgaggatcacgcgtttgtacaataccaccggctgaccttcgcgggtctgtttcacttcggaatcgcccggtacgcgcccggcagcagcggcggcctggtcaacgttggtattcaccagacggaattccagcgtcgcggtcgcgccgagaatttctttcgcgcgagcggtatcctggatacccggcagctcaaccacaatacggtctgcgccctggcgttgtacgacaggctccgcgacgcccagttggttaacacggttacgcagaatattaatgttctgctgaacggcgtattcacgcgcttcgctcaggcgcgcatcggtcattaccgcgcgaagttgattgccgctctggctggaaatcaccaggtcacgatgacgcggcgtcagataggcgatcgcctcatcacgcgctttgctgtcacggaacgtgatgctcagcccataattattttctttacgaacggtggtataaggaatgcctttttcacgcagatcgctgcgcaggctatcgatattttgttcctggagtttacctaacgcggtatccatatccacttccatcaggaagtgaacgccgccgcgcagatcaagaccgagcttcatcggatcggcgtgaatagccgccaaccagcgcggcgtagccggcgcaaggttaagcgccacgacatatttatcccccagcacgctcatcagcgcttcacgggcgcgtagctgggtatcggtggtgtcgaagcgcgcaagaatagcgccctcttccagtgccacagacttagcgggaattttttcttcttgtaacgttttctggacctggatcagcgtttgctcactggcggcgacgccgcgcacgccagtgatttgaacagccggatcctcaccatacaggttgggaagtgcgtaaagcaggccgacgataatcacgacgaccagcatgatgtacttccacaaaggataacggtttaacacggcagttccctttgggaaaacgaaatattacagcgccttcatggtgcctttcggcagaacggcagctacgaagtcacgtttgataaccacttccgtggtgtcattcagcgcgatggcaatgtagccggcttccgctactttggtcactcgaccaaccagaccgccattcgtcagaacttcatcacctttcgcaatggagtccatcagctttttgtgctctttggtgcgcttctgctgcgggcgcaggatcatgaaatagaaaatcagaccaaacaccaccagcattaaaatcagagacatcgggctgccctgcgccggagcacctgttgccgctaccgcatcagaaataaaaaagctcattcaaattccctcattattaaaattaatcaacgttcaaaggtggaacgggtcgcccctgacgttggtaaaactcggttacgaagctctctaatttaccctcttcaatagccttgcgtaaacccgccatcaaacgctggtagtaacgcaagttatgaatggtattgagacgcgcacctaatatttcgttgcaacggtcgagatgatgcaagtaagcgcgtgaataattgcgacaggtgtagcaatcgcactcggcgtcaagcgggctgatgtcgcttttatgctttgcattacgaatcttcaccacgccgtcggtcacaaacagatgaccattacgggcatttcgcgttggcatgacacagtcaaacatatcaataccgcgacgcaccccttccaccagatcttccggtttacccacgcccatcaggtaacgcggtttgtcagccgggatctgcgggcaaacgtgctccagaatgcggtgcatatctgctttcggctcaccgacagccaaaccgccgacagcgtagccatcaaagccaatctctaccagacctttcaccgagatatcgcgtaaatcttcgtaaacgctgccctgaatgatgccaaaaagcgcattcttattgccaaggctatcaaaacggtcgcggctacgcttcgcccaacgcaacgacatctccatcgagcgtttagcatagtcccagtctgccgggtacggcgtacattcatcaaagatcatcacgatatcggaaccgagatcgtactggatctccatcgacttttccggatcgaggaaaatcggatcgccgttgatcgggttacggaagtgcacgccttgctcggtaatcttacgaatatcgccgaggctgaagacctggaagccgccggaatcggtgagaatcggccctttccactgcatgaaatcgtgcaggtcgccgtgcagcttcatgatttcctgacccgggcgcagccacaggtggaaagtgttgccgagaataatctgcgcgccggtcgcttccacttcttccggcgtcatgccttttaccgtaccgtaagtacccacaggcataaaagcaggcgtttccactacgccacgatcaaacaccagacgaccgcgacgcgcgcgaccatcggtggtatctaactcaaatttcattatcactcctgcgtcagaaaaacagtccgacgtttaacgactcgctacggaatgattccatagctaataaattcccgaaggcgtcatcggcgcagccagtttggagtcggccagcgcacaaccaccggagcgtacacgcagtacgtgaggatggcgagcactgcccggcgtcaaaatggcaagtgagatagccttcttacggacgctcagaaatagcctgcggattgcacgtgataaacatcgcgtccccgtagctaaaaaagcgatatttttgttctaccgcagtcttataggcattcatggtgtgttgataaccggcaaatgcggaaaccagcataatcaacgtcgattccggcagatggaagttggtgatcagcgcatcaatcactttgtattgataacctggataaataaagatttgcgtatcgccgaagaatggctctatcaaatcgctttttgccgcctgcgccgcgctctccagtgagcgtaccgaggtcgtgccgacggcgataacccggttgccgcgcgctttcgccgccagcaccgcgtcgaccacctcttgcggcacctcagcatattcggagtgcatgatgtgatcttcaatggtatcgacacgcactggctggaaagtgcccgcgccgacgtgtagcgtaacaaacgccatttcgacacctttctcacgaagcgccgccagcagcggctcatcaaagtgcagccccgcggtcggcgcggcgacggcgcccggtttttcactgtaaaccgtctgatacagttcgcggtcggcgtcctcgtccggacggtcgatatacggcggcaacggcatatggccgatggcgttgagaatatccagcaccggacgcgggtcattaaactcaacttcaaacagagcgccgtgacgcgcggtcatggtcgcgtgaatactttcgtcatcgcccagtagcagttccgtgcccggttttggcgctttagaagcgcgaatatgcgccaggatgcgtttatcatcgagcatacgttcgaccagcacttctatcttgccgccgctggctttacggccaaacaggcgcgccgggatcacgcgggtattattgaagaccagcaaatcgccagggttgagcttatcgagcagatcggtgaaagtaccgtgcgtcagcgcgcccgtcggcccctctaatgacagcaaacggcagcgactgcgttccggctgtgggtagtgggcaatcaaggattcgggtagttcaaaggaaaaatcggtaacgcgcatgactctgactcagactaaaataagaggcgggtagtctagtgccggggcgttcccgctgcaaccgttacccgctttttggacagagaatcaataatgaattttcttgctcacctgcatctggcgcaccttgccgacagctcgctttccggtaatctgctggccgattttgtccgcggtaacccggcaacgcattatcctcctgacgtggtagagggtatttatatgcatcggcgtattgacgtcatgaccgacaacctgccggaagttcgtgaggcgcgagagtggttccgccatgaaacgcggcgcgtggcgcccattacgctggacgtcatgtgggatcattttttatcgcgccactggacgcaaatctctcccgattttccacttcaggcgtttgtcggctacgcccatgcgcaggtcgcgacgattctgcccgactccccgccgcgctttgtcaacctgaatgattatctttggtcagaaaaatggttagagcggtatcgcgatatggatttcattcaaaacgtgctgaatggcatggcgaatcgccgtccccggctggatgccttgcgtgattcctggtacgatctggacgcgcactacgacgcgttagaagagcgcttctggcatttttatccgcgtatgatggcacaggccgcccgcaaagcgctgtgacggcctgatagcgagggcgtgcgtcagatccgccgttggcagaaagatcgttcgctgtcataaaggagtcatcattacgatttataatgacccgatcgataggcaaaagctgtctcattgattgtcaagaccgcattgttttgtcgcttcgccctccctatactgcccgcgttgcgttctaaaacccttaatattgcaggagaattattatggtactggttactcgtcaggccccggatttcaccgctgcggcggtactgggtagcggtgagattgttgataaattcaacttcaaacagcacaccaatggtaaaacgaccgttctgttcttctggccgatggacttcacttttgtttgcccgtctgagctgatcgccttcgataaacgttatgaagaattccagaagcgcggcgttgaagtggtcggcgtttctttcgactctgagttcgtccacaacgcatggcgtaacacccctgtcgataaaggcggcattggcccggtgaaatacgcaatggtcgctgacgtgaagcgtgaaattcagaaagcttacggtatcgaacatccggacgaaggcgttgcgctgcgcggctctttcctgattgacgcaaacggtattgttcgccaccaggtcgtaaacgatctgccgctgggtcgtaacatcgacgaaatgctgcgtatggtcgacgcgctgcagttccacgaagagcacggcgatgtctgcccggcgcagtgggaaaaaggcaaagaaggcatgaacgcctctccggacggcgtggctaaatacctggctgagaatatttccagcctgtaagtcagtgcattgataaaaggctcgcgaatgcgagccttttttatgcgtgaggtattatgaaccacctcgcctcaacgattcatccataccgtcgcggaaatcgcgggtaaactaagtcttccctcgcggatgtcaccgcttcccgttttacattgccatccggccacgttcagcaacggcaacgcttccagcgccacttcacaggcctcgccccggttaatcgccaccagcgcccgctgctgctgataaactcgcacgaataccactacgtcaccttcggcatacagcgcctggcatccgccacgacgcagcgccagactgctctggcgcagtttcgccatacgctggtacagcgccagcaagttgccgtcctgcttgcgttcatcccatgggaacggtttgcggcacatggggtcatttgcgccgtccacgccgacttcatcgccgtaataaatacatggcacgccgggccaggtaaacagccagaccaccgccagcggcaggcgcgccgcgtctttacccagcagggttttaaagcgcgcagtatcatggctgtcgagttgattaaacatgcgcagttgctgctggtgcgataatccggcgcggtagttatccatccacgcgatacaggtccgggcatcaatatgctgtggttcgtaagcgatatcagtattggcgagaaatccccacagcgggaaggtgaagccgcgataattcatggcggcatcttccgcatcggcctgtagccactgccgcgcatcgctgaaatgttcccccacaatataggcttcaggctgcgcctcttttgccgcccgggtaatgccggcgacgtgctgcaaattgtggcgcgccccgcccgcctcgcccagcatatgtacgacatccagccgccagccgtccatattccacggtgcctttagccagtgacgaacgatactgtcctcaccgcgatagatctcatccaccagcgtttctgattgataatcgagtttcggcaggctcggataacccagccagtccagcgccacgccttgtggtgaaaaggagtaccagtcgcgccacggcgagtccgggtgatggcacgcgccgccagtgctgcggttatgcctgtcaaaccacgcatgcgagtcgccgctatggttaaacacgccatccagcaccagcctcatgccctgtgcttgcgtttcacgccgcaggcgtagcagcgcccgatcgccgccaaattgcggatcgacatggcgataatcttccgtgtcgtacttatggacgctcggcgcggtaaataccggattcagatatagcgctgtgacgcccagttttttcagatacggcagcttctcacaaatgccattcagacagccgccgtaaaaggtggaaccgcccgcctggggggttaaaggatcgtcccagtcgcgcagcacaatctcctgacccgcggcatgatggtaatacactcggtcctgatcggcttcacgcgtcgcgctgcgggcaaaacgatccgggaagatctgataaaaaatttgatcggcgacccactgcgggccgctatccggcacatcaaccgcaaattgttccagacgcgcgggtggaaagcagctaaatccctgcggcgtaaaccatcgctggcggtcatgccaaagcaatttaaagctgtaacggcgacggggctgccctaacgcgatattgagcgtcgctcgccacgccgtcacgcccggctgcggctggcggcgctgtttgcgcatcgccagtgagatttcttcgttatcgaattctgagcgcaacgtcacgcgagacggcggattttctccgctcagccacagcgtaatggttaatttatcgttatgttgcttaacaaacggggcaaccggtaagtgccaggcattcaacatctcgtatcccctctactaaaaatggggccaccttgccacagagatttaaaggataactcatcatccgggggtttattaggggaggagactccaggaggagaaacggctccgcttatccggcctgccgttgcctgcagaccggataaggcagagaaaaacgactacgcctgcgccaattgacggtcgcgacggcgtttaaatatccagccaatcaacagcagaactatccaggcgaagcccacatacagtgagatgcgggtattcggatggtagccgataagcgcaataatgaagaccaggaaaatcagacccgctatcgtcgttacgacaccgcccggcaccttaaacttcagcgcttttacctcttccggcggtaaacgacgacggaaggcgatttgcgacagcaggatcataatccatacccataccgtcgcaaacgtcaccagcgaggcaatcaccaggaagacgttttccggcatgatgtagttcaggtaaaccgcaaacagcagcgcaatcgtcatcaccagcacagtgacccacggaataccacggcgtgacgttttggcaaagactttcggcgcgctcccctgctccgccataccatgcagcatacggcctacgccaaacacatcggagttgatagcggaaagcgaggcggtcaataccacaaagttcagaatgctggcggcaaaggtaatccccatatgctggaacgtcagcacaaatgggctgccgtttgtgccgacctgattccacggatagatagacataatgacgaacagcgtgccgacataaaataccaggatacgcatcggtactgagttaatggcgcgcggaatggatttctccgggtctttcgcttccccggcggtgataccgataatctcaatcccgccgtaagcgaacatcaccatttgcagcgacatgatcattcccagccagccattgctgaagaagccgccgttgctccacaggttatgaatgccagtcggctgcccgccgttgccaattccccacacaatgatgccgatacccgcgacaatcatgataataatggtggcgactttgaagaaggagaaccaaaactccagctcgccgaacatcttgacgctcatcaggttgatggcgcaaatgatcagcaccacgctaagcacccaaatccagtgcggcacggcggggaaccagacccccatgtaaatgccgaacgcggtcacgtcagcaatggcgacgatcaggatctcaaaacagtaggtccagccggtaatgtagcccgcaagcgggccgaggttttcctgcgcatagcgcgaaaatgagctggcggcagggttgtgaacggacatttcccccaatgcgcgcataatgatatatgccgcgaccccgccaataatataggccaacagcacgctcggccccgccattttgatggcgtccgccgagccgtaaaacaggccggtgccgattgccgaacctaatgccataaagcgaatgtgccgggtgctcagcccacgctttagcttattattgctttccatcaatttctgacctatcaacacaataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaccacggggcgttaagccccgtggtgtacacatatgtcagcgattttagtgagcgctggaggtcacctgccgacccgccgcgcgatcccagataatcgccaggatcaccatcaccaccgttggcatcaaccacgccagtccctgttccgccagcggcaaacgctgactccaggctggcagcatatcgccaaaggcagatgctttgatgccgtcaaggataccaaaaagcaggctgataaacatggccggcgcgatgatacgggtggaattatgccaccatgagcgggtaaaacttaatacaaccagtgcgatacacggcggatagatagccgtcagcaccggaatggagatttgaatcagatggctcagtccgagatttgacaccaccatagagaagccgccgagaataaagaccagcgtgcggtaagacagcggaatatactgcgcgaaaaactcagcgcaggcgcaggtcagccccaccgccgtcaccagacacgcgataaagatcagcgccgccagcaggaagcttcccgcgccgccaaaggtatgctgaacgtaggcatgaagaatcgccgcgccgttcgctgactgatcgaccagcgtcgcgctgtcagaacctaagcgaaacaaggcaaggtaaagcagcgtcagccccacgcccgccatcaggccggcccagaccgtgtaacgcgtcaacaggcgcgcttcggtcacgccgcgagaacgcgccgcgttcacaataacgataccaaacaccatcgcgcccagcgtatccatcgtcagatagccgttcacaaatccgttagaaaaggccgcattctgataagcgtccagggcgttgctgattggaccggcaggccaaacgatagccgcgacggacaggatgaccagcgcaataattttcaacggcgccaggaaattccctaccgtatccagcagcttacccggatagagggaaaccagaataacgatagcgaaatagaccacgctgtaaatcagcaacggcattgcagaatcgccggtcaacggagcgataccgacctcaaacgacaccgtcgcggtacgcggcgtcgcaaataacggcccgacggccagatagcaaacggtcgccagcaggagtcccgccactttaccaatcggcgtactgaggctgtctacgccgccgccgactttcgccagcgccacaacagtaagaaccggtagccctacggcggtaatcagaaagccaatagcggctgtccagacgtgttcacccgcctgcaaaccgaccataggaggaaagataatattgcctgcgccaacgaacagcgcaaatgtcataaagcccagggcgatgatatcgcgcgattttaactgatgggtcataaagtcttactgcctgtggatggtgatgttgtaaacattaaaatttttgcctttcccggaggattataaagcggcgttttttatcaatttcagcgggaaaaactcccggaccgatgcggcgaagaattgtttttcgatttaccgcgcaaatgcagtcgtaatgacagcacctgaagcgcaatttaaacgcttataacgttttaaagcaaggtgggatctaaaaaccagatgaatatcgcgatatgaaatttacaaccagaataaaacaccattctcatgaaaaagttatggctaatcatgcgaacaaaaaatcaccaaacgttgaatgtttcaacgagcccgtcttaactgcaaagaaaataagccagcatccgctggcttatggaaagttatacttacgaaaggcaattaatcactatttttggcaattaaacgttccggcagcacaaagctaaatcgcgttcctttgccaggcgaactgtcgatttcaaggcggctttcatggtgattcaacgcatgtttcacaatcgccaatcccaggccgctgccgcccgtttgccgcgaacgcgctttatcgacgcggtagaagcgttcggtcagacgaggaatatgctcggcagcaatccccggaccgttatcttgaatgcaaaattcagcgccatgcgcggcacgtcgccagctcaccgtaatatgcgttcccgccggcgtatggtttactgcgttatataccaggtttgagatcgcgctacgtagctgctcttcattgcccagaacgctaagactatcgtcgaccgcaaacgtaaaggtatgtttctgctggctgagcgtctgcgcttcacgctccacgacccgcagcatcatcggtacatccactttttcatttaataacagcgccggggccacctcaattttagacagcgtaagcagttgttttaccagcccttccatacgatacgtttgctcgcgcatcgtatgcagcgctttctctcgcgtcgccccttccagcgcctgttcctgcatcatttccagatagccttgcaataccgtcaatggcgtacgcaactcatggctaacgttggcgaaaaagttacgtctggcgccttcaagctgatgcatttgcgtcacatcgcgcgccaccatcaggagttgtttatcggtataaggcatgacgcggatctccagatgccgcccggtattgagcaccaaatgaagcggacgggtgaaatcacgcgtttttaaatactgggtaaactccggataacgcagtagattgagaatattctgcccgttgtcatccggccagcgtagccccagtatctgttgcgccaaaccgttacaccaaaaaatgccgccctcttctgtggtcagtaccacggcatcaggcagcgactccgcgccgctgcgaaaacgtttaatcaggttccccagctcgcggcgacgcttcttatttcgcaactgcatctggtgtaaaccgtataacagcggttcccaacttccccgccccggcggcggcgtcatacttctgtcgacccaaagccaccaggagaggcgtaacaaattccagaaatgccagacaagcagtcccgtcaccgccgccagtaaaaaccacggcagataaccaaaaaaagcgctaaggataagcgcggggatgcaacagagcaccagctccagcaccagccttttccatgacagccgttccagcacgcgtcatactccctcaagaatggaaagccttctccgccagaaacctgtgatcaactggcggaaaaggcattaaaagcgggtcgaaaaacgataccctgtcccgcgtaccgtttgcaccatccggtcgtggccgctgtgctccagcgccttacgcaaacggcgaatatgcacgtcgaccgtccggtcttcaacgtacacattggtgccccagacatgattgagcagctgttcgcggctgtaaacccgttccgggtgcgtcataaagaaatggagtaatttaaattcggtcggccccatatccagcgggctgtcgccggtcatcacgcggtgagagccaggatcaaggctcagtccctgcatctcgatcacctcttcgaccgccatcggcgagatacgccgcataacggctttaatgcgcgccaccaactccttgggggaaaacggcttggtaatgtaatcgtcagcgccggtttccagcccgcgcacacgatcttcttcctcacctctcgcggtcagcataaccacaggaatatcccgggtcatggcctcacgtttgagatgtttaataaactgtaaccctgacccgccgggcaacatccagtcaagaaggatgagatccggccagggttcattaagtttattcaccgcactgtcataatcttcggcttctacgggctgaaagccattttgttcgagcacgaagcacaccatttcacggatcggcgcctcatcttctacgaccagaatacgtctcgccataatttgccctgttagtcgttagttatcaatgccgcgccattatgcgtcagatttatgacagatttatgaaaaaaaaaggcggcattgacagcatgttgatgatttatgacaccggtgaaaccgtgcattaccgtgtaccggcggtaaattgcgcccaaaaatggaggggatgacgtgtataatcccgttcacgctttttttgcatggaacaattatgcgcatcctccacacctctgactggcatctgggacaaaacttctacagtaaaagccgcgccgcggagcatcaggcttttctggactggctgctggagaccgcgcaggcccatcaggtggatgccattattgtcgctggcgatatttttgataccgattcgccgccaagctatgcccgagaactttataaccgtttcgtcgttaatttacagcaaacgggctgtcatctggtggtgctggccggtaatcatgattccgtcgccacgctaaacgaatcgcgcgacattctggcgtttctcaatacaaccgtgatcgccagcgcgggctatgcgcctcggctacttcatcgtcgcgacgggtctccgggcgccgtactgtgccccattccctttttgcgcccgcgcgacattattaccagtcaggcgggattatccggcagcgagaaacagcagcaacttcttcatgcaattgccgattattatcaacagcagtatcaggaagcgtgcctgctacgcggcgaacgaaagctgccggttatcgcaacgggacatttaaccaccgtcggcgccagcaaaagcgatgcggttcgcgacatttatatcggtacgctggatgcctttccggcgcagcatttcccccctgcggattatatcgcattgggacacattcaccgcgcgcaatgtgtcggcggcacagagcatatccgctattgcggctcgcccatcgccctcagctttgatgagtgcggcaaaagcaaatgcgtgcatctggtgaccttcgaccagggaaaatggcaaagtaccgaaagtctggctgtccccgtgactcaactgttggcggttttaaaaggcgacctggcgtcaattaccgaacagcttgagcagtggcgcggcgttgagcaatcgccccccgtctggctggatattgaaatcaccaccgatgattatctgcatgatatccaacgcagaatacaggcattaacggagtcactccccgtagaggtattactggtgcgccgtagccgcgaacagcgtgagcgctcgctggcgaacgagcggcgggaaacattaagcgagcttagcgtggaagaggtttttgcgcggcgtctggcgctggaagcgttagataccccgcagcgcgagcgcctgaatcagctcttttccagcacgctctacgcgttgaatgaggagcatgaggcatgaaaattctcagtttgcgtctgaaaaacctgaactcgctgaaaggagaatggaaggtcgactttaccgccgaaccgtttgccagtaacgggttattcgccattaccggcccgaccggcgcgggaaaaaccaccttgcttgacgccatctgcctggcgctgtaccacgaaacgccgcgcctgaatacggtatcgcaatcgcaaaacgatttgatgacgcgcgatacggcggaatgtctggccgaagtggagtttgaggtaaaaggcgaagcctggcgcgcgttctggagccagaaccgagcccgaaatcggcctgacggcaatctccaggccccacgcgtggagctggcgcggtgttcagacggaaagatctttgccgataaggtaaaggataaactggagatgatcgccacgttgaccgggctggactacgggcgcttcacccgttcaatgttgttatcacaggggcagttcgccgcctttcttaacgccaaagcgaaagagcgcgcagagcttctggaggagctcaccggcactgagatttacgggcagatctccgcacaggtatttgaaaaacataaatcagcccgtctcgaactggaaaagttacaagcgcaggccagcggcgtcgccctattggcggacgaacagttacagcaactggaagccagtttgcaggcgcttactgacgaagagaaacgcctgctggccgaccagcagggacagcagcagcaccttcactggctgacccgaaaaaacgagctccacactgaattacacgcccgacagcaggcgctgtacgcggcgcaagaggcgcgagaaaaagcgcagccgcagctcgcggcgctgacgctggcgcaacctgctcgccagttgcgtccgcattgggagcgcattcaggaacaaacccgcgccgttgagcgtgttcgccagcacagtgatgaagtgaatgctcgcttacaaagcgcgtatcgcctgcgccagcgtatccgcgcctgcgcgcatcgacaattcacgcaactgaacgccacagggcagcggttgaagacatggctggcggaacacgacggcatccgcgtctggcgcagcgaactggcggggtggcgagcattattaacacaacaatcccacgaccgggcgcaactgagccaatggcaacagcagttgctgagcgatatgcgtcagcgtgatgcgctaccgccgctcacgctcgacctcacgccacaggcgctggcggaagccagggcattgcatacccggcagcgtccgctacgccatcgtctcgccgcgcttcaggggcaaattctcccgaaacaaaagcgtcaggcgcagctacaggcagctatcgcgcgtcatcatcaggagcagacgcaatacacccaacgtctggcagataagcgcctgagttataagactaaagcgcaggagcttgcggacgttcgcactatttgcgagcaggaggcgcgcatcaaagatctggaaagccagcgggcgcacttacagtccggccagccgtgtccgctttgcggctcgacgacgcaccccgccatcgccgcctatcaggcgctggaactgagcgcgaatcaaacccgccgcgacgcgctggaaaaagaggtcaaaacgctggcggaagaaggcgctgcgctgcgaggacagttagatgccttaacgcaacaattacagcgggatgaaagcgaggcgcagtcgttgttgcaggaggagcaagcgcttactgaggaatggcaaacgctgtgcgctacgctgggcgttcagctccagccgcaagaagacctcgctggctggctgaccgccgcggaagagcatgagcaacagttggatcagctcagccagcgtcatgctctacaaacgcaaatcgcggcgcatactgaacaggtagcgcgctttaccgcgcagattgcacagcgtcaggcgtcgctgacggctgatttggcgcagtatacgctttcccttcctgcgccagaagacgaggcatcctggctgaatgagcgcgccgacgaagcgaaaatatggcaacagcgtcagacagagttcgcggatttgcaaacgcagatcgacaggcttgccccgttgctggagacgctaccgcaaacggataccgcggattccgacgacgacgtgccgctggataactggcggcagacgcatgatgagtgcgtgtcattacaaagccagttgcaaaccctgcaggaacagacgacgcaggaacagcagcgcgccgccgaggcgatagcgcactttgatgcggcgttaaaaaatagcccgtttgacagccaggcaacgttcctggcggcgttgctggatgaagagaccgtgacccgtctggaaaaacaacaacaaacgctggaaagtcagctacaacaagcgaaggcgttaagcgcgcagtccgcgcaggcgctggctgaccatcagcaacagccacccgccggtctggacccaacgtgtacggcggagcagctcgcgcagcggctggcgcagttggcgcaacaactgcgcgagaacacgacacgccagggggaaatccgccagcaaattaaacaggatgcagataatcggcagcgccaacgggcgctgatggcggaaatgaagcaagcctctcagcaagtggaagactggggctatctcaatgcgctgatcggctctaaagaaggtgataagttccgcaaattcgcccagggactgacgctggataatctggtctggctggcgaatcatcagctcacccgcctgcatggccgctatttattgcagcgcaaagccagcgacgcgctggaactggaggttgtcgatacctggcaggccgacgccgtgcgcgatacgcgaacgttatcaggcggcgaaagcttcctggtcagcctggcgctggcgctggcgttatcagatttggtcagccataaaacgcgcattgattccttgttcctggacgaaggcttcggcacgcttgatagcgaaacgctggacgccgcgctggatgcgctcgacgcgctgaatgccagcgggaagaccatcggtgtgattagccacgtggaagccatgaaagaacgtatccccgtgcagataaaagtgaaaaaaaatcaatgggcttggttatagcaaactggacaaagcgtttgccgtggagtaacgcgagtgtcatcctgcgcacagcataccgtcatgacatagcataataatgaatacacaaagacgaataaggaatggtattacctcgcgcttatccgcaagctatacgttgattggctgtgacaattcatagccacagcgcgcgacatgcgtcttcattttcggcaggtggtatgaaaaaagttattttttctttggcgctgggtacgttcggactggggatggccgagtttggcattatgggcgtgctgacggagctggcacgcgatgtcgggataacgattcccgccgccgggcatatgatctcgttttacgccttcggcgtcgtgctgggcgcgcctgtaatggcgctcttttccagccgcttttcgcttaaacatatactgctgtttctggtcatactgtgcgtgatgggcaatgccatatttaccttttcctcgtcatatctgatgctcgccgtcggcagactggtttccggctttccacacggcgccttttttggcgtcggtgccattgtcttgtcaaagattatccgccccgggaaggtcaccgccgccgtcgcgggtatggtttcagggatgacggtggcgaatctggtgggcattccgttcggcacttacctgagccaggaatttagctggcgctacacctttttattgatcgcggttttcaacatcgccgtgctcaccgcgattttcttctgggtgccggatattcgcgacaaagcccaaggcagcctgcgcgagcagttccacttcttgcgtagccccgcgccgtgactcattttcgccgccacgatgttcggcaatgcgggcgtttttgcctggttcagctatatcaagccatttatgatgtacatctccggtttttcggagacgagcatgacgtttattatgatgctggtcgggctggggatggtgttaggcaatctgttaagcggcaaactctccggtagatatacgccgctgcgcatcgcggtagtgactgacctcgttatcgtgctctctctcatggcgctctttttcttcagcggatacaaaacggcatcgctgactttcgcgtttatctgctgtgctggtctgtttgcgctctctgcgccgctgcaaatcctgctgctgcaaaacgccaaaggcggcgaactgctgggcgcggcgggagggcaaatcgcgtttaatctcggtagcgcgattggcgcctggtgcggcgggctgatgctgacgctaggttttgcgtaccactatgtggcgcttcccgccgccctgctctcgttttccgccatgtcgtcgttgctggtatacggacgtctaaaacacaagcagccatcggtcacgccggttgccggatgacgccatccggctagaaacgttacgccagcggccacagccaggccgcgccgcgcacgccgctcgaatcgccatgccgcgccttacgtaccggcgtctcgcactcgccgccaaaaacaaacgatttcatcagcgacggaaccgttttgtacaggcgctcaacattgctcataccgccgcccagcacaatgacatccggatccagaatattcacgacatgagataatgccttcgccagccgtagctcataacggcttatcgccagttccgccacggcgtcctgcgcgtcgaccagacgaataatctcatcgccttttagcgttttaccgctcaaacgctggtaatccgtggcgaatcccgtaccggaaataaaggtttcgatacagccttgtttaccgcaataacagggaatttcttcgcggtaacgcaactcatcgtcatccatccacggcaacggattgtggccccattcgcctgccgtaccgttgccgccgatgtgcgcccggccatttagcgctacgcccgcgccgcacccggtaccgataatcaccgcaaataccgtttgcgcccccgccgccgcgccatctaccgcctctgataccgccaggcaattggcatcgttggctaaccgcacttcacgcttcagacgacggctcacatcgctatcgaacggctggccgttaagccacgtagagttagcgttttttaccacgccggtgtaaggcgagagagaaccgggaatgccaatgccaacgctaccggtctggccggtcgcctgttccgccatgtcgaccagcgtagcgatggtttctatcgtttgctgataatcctcccgcggcgtaggcagacgatggcgaaaccgctgctctcctgcatcatcaagcgcaatgacttccgtttttgtgccgcctaaatcgataccaatacgcacataccgctcctcattttttgggaatatcaacagggtagaattcaccgttctgattggcaatgcaagcctgccgacaattcgttactataccgactggatttaacgacaaggccgtggaaattatcatgctgtggttcaaaaatttaatggtttaccgtcttagccgcgatatcacattacgcgccgaagagatggagaaacagctcgcctcaatgacgtttaccccatgcggtagccaggatatggccaaaatgggctgggttccgccgatgggctctcacagcgatgcgttaacgcacaccgccaatggccaaattattatttgcgcgcgcaaagaagagaaaatcctgccatcgccagtgatcaaacaggcactggaggcgaaaatccagaaactggaagccgatcagggacgcaagctgaagaagacggaaaaagattccctgaaggatgaagtgttgcattcgttgctgccgcgcgcgtttagccgcttcagtcagacaatgatgtggattgataccgttaacggcctgattatggttgactgcgccagcgcgaaaaaagcggaagatactttggcgctactgcgtaaaagtcttggctcgctgccggtcgtcccgctggcgctggaaaatccgattgagctgacgctcaccgagtgggtgcgctccggtacggtcgctcagggtttccagttgctggacgaagccgaattgaaagcgatgctggaagatggcggcgtgatccgcgcgaaaaagcaggatctggtcagcgacgagatcgccgttcatattgaagcgggtaaagtggtcacgaagctggcgctcgactggcagcagcgtattcaattcgtcatgtgcgacgacggctccattaagcgtctgaaattctgcgatgagctgcgcgatcagaacgaagatatcgaccgggaagattttgcccaacgttttgatgcggactttatcctgatgaccggcgagctggcggcgctgattcaaagcctggtggaaggattaggcggcgaagcgcagcgctaaccagagggtccctctccgccggagaggggactcaccgttacaaatagcggcacagatacgaggtgggctcagcgacctgtagatgaaactcgctgtggccaggcacgttaaacacctcaccggctgtatacactttccattcgacagttcccggcaacagtaccttcaacgcgccgctcacaaccgtcatctcttcgggttcggcggtgccaaatgtatactccccttccgccatcacaccaacgctggcccggccggtgctactgctggtaaatccaatagacttcactttcccggaaaagtattcattgctttgtagcataatcaggccccgtctcattattaaattaacacccaatatagagtcctgacgttcggcctgtcacgtaaaattagacaagcagttctgaagctaaccgcgcaatcaaaacattagagagtaaaaccggcacatccagcgcctgctgtaaaatatcccgatgacgctgatgaaaacccagacaatccagcataatgacgtccgcgccttgatccagtagcgcctgcccggcatcaattaactgttgctcagaaccgtgaaccggattcgccagcgaatacaccggcggcatttgcaatacctgccattttttctcctgggccgccagaagttctgcaacaggcacaatcgcgcccacctgatgtccatccacaatagaggcgacaagcggtggaataatacgcagcggttcaagcaaaatagaattacgggctgccgtacttttaatcgccgcggtgctcatcagtataatgacatcgtaaccctgattatccagcacctcgacaacgctctgtaaatctcgctccactttctggcgggaaacatgggctatctggttatcattcagcaacgtcaaaagcagatcgtcgccaggctctacagcgtaatccgccataacgtcttcccggctcatttttcccagcaggctatgatgggttatgggttatgtgttgttcgtcgatgtattccgtcagaagcggtaacacttcgctcattggcacaacgccgattgtgaggattgccaacgacgcactcatttttattccaccttattacttcgtcgtaattcccgggcaaatattcacacgctcaccgcgctacctgccctacaaatctcagaaagcgtagcagcagatgagcaacgtattgtgtaaagattccaaataactccaatattgtattgttatcgcttaatttatggttttagttgccagtataaatgtttcaagaatgtgatggagatacaatttaggggtactcagaatcccttccgagtggttcatgcgtctatgatttatccggatcttcgtaacgttttttcgcatccatcgcttcttctgcggtcggatgctcgctgatgagcgaatcaggtttcggatggtcagcccgtagctgataccacgtcaccgtctggcccggcgtgcctttttcaatggtgacgatataagcttcccgcggataaggtggtctggttggcatagcgtttcctttattctgggtgagcgttaagtatagacatctccctgtaaccgttgcgtcgacggcggcagcgccgcaataatttcagaaacgacctgggccggcgctttcgtcgcgtcaataatgtaatgcgccgtttcgcgatacaacgcgtcacgctgctcaagcacttcccgaacctcttcgctcaacggcttgccggtgagggtcgggcgcagatccgcttcaggttcagcctcaagccggttaaccagcgtggataccggcgcgcacagataaatcactacgccaacacggtgcatataacgtcggttatactccgtgagaataataccgcctcccgtcgccacgacagtcgaaggcgcgcttaccgcctccagggccgcggtttcccgggcgcggaaccctccccagccttctttttcaacgatatcagcgacgctcatctgcacgtgcgattgcagccagcggtcggtatctgcaaaccgaaaaccggttgcctgcgccagcgccataccgatggtggttttcccacagccccgcgggccaacaagataaagaggttgcatcatagcaggcgttcccccaggaactgcgcatacgcaggatttgatatcagtaatgttataatcatatcatctaactagtacaacgcataaatgtaaataataatttacacaaaggtactaaagtcacaatattagtactatagcaagaatcagaaatgaataaactgtaaatttttcattacatgatttattttttacgctggctttccagccaccacttatccagctcggcggcaaaatgctgacgatcgcgcggcgagagagtgtttggtccccccgtttgtacgccgctggcgcgtagcgtgtccataaagtcacgcatcgtcagacgttcgcgaatcgtggcgtcgctatagcgttctccccggggattaagagccgcagcgcctttttccagcacttcagccgccagcggaatatccgcggtaatcaccagatcgcccgcttcgcattgacgcacaatttcattgtccgccacgtcaaacccggcggccacgcgaagcgtgcggataaaacgcgaaggcggcacgcgcaaggcctgattggcaaccagaataagcggcaactgcatccgctcggcggcgcggtacaaaatttctttaatgacattcggacacgcatccgcatccacccagatggtcataatgtctcccgtacggtatacaatcttttattgtctcgcgcttttgtctttcatcaaagtgctgtttctccttctgcccgttttcaatccgcgttaagctaaccattccccataacacacaaacatagggagtgacgagatggagaagaaaatcggttttattggctgcggtaatatgggcaaggctattcttggcggactgattgccagcggtcaggtacttcccggccagatctgggtctacaccccctcccccgataaagttgccgccctgcatgatcagtacggcattaatgcggcgcaaagcgcgcaggaggtcgctcaggtcgcggatatcgttttcggcgcggtaaaaccgggcattatggtgaaagtgctcagtgaaatctcctccagcctgaacaaagactcgctggtggtctctatcgccgcaggcgtaacgcttgatcagcttgcgcgcgcgctgggacacgaccgtaaaatcattcgcgctatgccgaatacgccgtcgctggtcaacgcaggaatgacctccgtcacgcccaacgcgctggtcacaccggaagatacggctgatgtgctgaatattttccgctgctttggcgaggcggaagtgattgctgagccgatgatccatccggtggttggcgtgagcggatcttcgccggcctatgtctttatgtttatcgaggcgatggcggacgctgccgttctgggcggtatgcctcgcgctcaggcttataaattcgccgcgcaggccgtcatggggtcggcgaaaatagtactcgaaaccggaaagcatcccggcgaactgaaagatatggtgtgctcgcctggcggaacgacgattgaagccgtacgcgttctggaagaacgtggcttccgcgctgcggtaatagaagcgatgacgaaatgtatggaaaaatcagaggcgctcagtaaatcctgaagcccggctggacgtcatgccgccacttcggtgcggttacgtccggcattctttgctttgtaaagcgccatatccgcagactttaaccattcccgataatgaccgatttgtggcgttaacggcgccacgcccacgctgatacgtaacatgacctgcggcgcgcccggcaagcgtaaggtatttagccgttcatgcactcgcgacatggcggtaatcgcgctgtctgccggcgttccgcacataatcaccgcaaattcgtcgccgccaaagcgcccgataatatcactcccgcgtagcgttatctgtaattgacgcgtcagggcgataatagcctcatccccagcatcatgtccccaggtgtcgttaatgctcttaaaatgatcgatatcgataatcaacaatgtcgcctcccgatggtggcgtcggctgtgatcgaattcattacgtaataaaatttcccagtggcgtcggttatagacgccggtcatgccatcccgcgaactcatcgcctgcaagcgtcgcttatgttccgctaatttaatggccgtttgataacttacccaggcgaacagaagcggatacaacataatgacgggcaaagagagcgtgacttccagcgacgagcttcgcatcgcgacgggtagcccggtaagctgcaacgtcaccagacatgacgccagcaaaaggcccattccgacagtgaatagccgccgcccgccagcgcccatcagattcatgctcatcatcataaacagcgcggcggcaggcaacatattgacgcccatcaacgcgatccacatgccggagaggatcgcatccactttcaggttgtaaatttcctggcgtagcggatcaagggctttcgccgcccactgccacgccagatgcggccagacaaaagaccagccgaccagcaataaccaccagccgccaaagacaggttgcgacactaacacggcggccaccggtaaaagcatcccccctaaccccaccgcgcgcggtagcctgatgcgccgggcgaagcgcaatccggagcgctgacgatcatcagaagggtcaggcggcgctaccgcctgctcaaccgcttttcggtaaaaattttcatcattcattatttttgggaacatttagaaacaattttcccaaattatagaaacagagcgcatggagggagtatgaaatttcgggtgagtgtttttcagggctcacccgatagcactacgccgcttttttcaggcaggcgctcataaacttgctacggtcatcgcctttcagtgattgttccgtcgcctgaacattgcattcacgcattttctgctgttgcggcgtcaggcttttctcgccaggggctgactggctgtttttcaggcagtcgctaaggtaggttttacgcgcatcgcctttcaacgcttgcgctgtcgcctgctgattacaggtcgtcatgcgctgctgttgcggcgttaacggtttctcggttgcgccgacggcggttaaaaagaccaggccaaaaagtaaagtcaccagtaatgttattttcatagcaccatccttttgtcagtgtacacattacacgttgtccctttgggaaatatcccagggactttatataagtctggctgttactggcaaaaataccacccggcagtaaaagtattacttaccgttagcaatatatgttttattgattgacaaaccgtaggctaatgtgcaactcgattatccacagtcacactggcaggatgcagaagaacagcgcataacgttacactgttattaccatagccgcttcgtttttattttgctctgtattaaccagaagaaaataaaaacgaagcggctatgttatttcataaaagtaacgttataacaactgtgttgttttaaatacgattagtgccgggggtgtctcagcaacttttttacatattggcgcagcaattccgtatcgtgatcaggaacgctggcatccggctttacgccttcaagtgccccctctacctgacgtatcaacatctcctgctcgttttgcgccatgttacgtaacattgctgtgacgataatctctaacgcttctacctgagcaaccagttctttcgactcttcttctttttgggctagcttaagcaacaactctgctatgagatttttcatgaccatatttccttattagttccagggtgacgttatcactatgaagaaccactgcctagaggctgaaagtactatttttatgatacaggaagaactttacacaaataattatcactgtcgccgcagcgaaacgtttctcagaccgaaaacgagacgataataaaccatcaaaaaacaataatcacgctatatcataatttaaggttatgccatctatagaaaaacttcacggataaagagtatatcttttaatttaaaccatatcgtaacggcagaagcgccgttacgatgcaccgctattggcctttcgctttttgcgcgttacgccgatgacgtaacgccagggtcagttgtccaatattgatcaacacgatcgccgccgtagcgataaaaacccagcggaaaccggccatcgccgataccgtcgcgcccatcaacggcccaaccacgttgcccaggtacataaatgactggttgtagccaaaaatacgtccggtaatttgatcgctggagtatttcaccaataacgtttgtacggcgggtaacatcgcgccatcggcaaagcctaacaagaaacgtaacagccccagctggaacggcgtggtgacccaggacatcgcgaagaaaagcagcactgcgcagataagcgtggccatcagaattctttccgtgccgattctgtcgccaagttttcccaggcgaggcgcggagataccgggcaccgaggcgattaacccgctaagaaaggcgatgttattactgtccggcatcattgatttgataaacagcgccaggattggactgatggaaccattacagagttgaatgaccatcgtggtaaaaaacaaactgatcaccagcgcaggataaggtaacgacgcaaaaacggctttaccgctcaggcgttcgcttttcttgatgaccggacgcacgccttctttaattaaaaatagcgtgaccagaaagctcaccaccaacagcatggcggtaatcagaaataccgcccgcagcccgatatgatccgcgacaaagccgcccattaacggcccgccgataacgccgctgatctgcgcggtagaaagcgtactgagcgcccagccgctacgttcgcgcggtacctgagaggctaccagcgccatggcattggggatatagcctgacgttaaccccatgattccgcgcagcaggaaaagttgccagacatgggtcgcgaatgcttgcagtagaatagctatcgccatcccgagcgacgcgcgcaatagcatcagtttacgccctttacgatcggcgagactgccccacatcggcgatacaatggcggaaataagaaacgtgatgctaaacgttaacccggaccacattgataacgcttcatgggaagagacgccaagctgggaaatatacaggggtaaaaatggcaggatttggctgattgccagcccggtaaaaaaacatccaaaccaaacggaaattagattaactttccaggattccataagactcgtaacggtaagtagctgaaaatacgcgttagcttagcaagctctcattttcctggtggttccagaggtgcgatacgtcacactttgctattttgtctccccgttcatcatttttgtgaaacatatcacattatatagccgcgaaaggcagacgtttatgctttaacgacacacgccgtagccccgcattccaagatgaaaatggttagcatgagcagcgttatagtcaggcccgagcccattgccataataatggcaactggcgtttaacatagcgcgtaaccagggccccgtctcctcacgcccccagccgcgcaggacagtgatttttcggccatctgatagttgaaacccgctgacatccagcgcttctgcgctggcatgttcactgcgacgcgcatccggacggtgataaatattacggcaggcatagctgcccagatgttcgatgcgggtcaggcggcgctgcatccacgtttctgttaaaggttttgcctgctgttcgacaaacagcgcggaacgcagcgccaacgggcaggaggctaaaaaactgctgctcagttttacctggccaaaatctctgacgcgcacaacatgggacaagggacattcaccagcgctatccgcaacaggttgtgatgaaattaatccctgttgattggccgccgtcaacagctcccggcactgcgacggcgtcaggcgctgtagtttgaaggtagtgatccagcctggcggatcggcaagttgtagcggagcaaaaggattataataagagggaagataacgatatcccagcccgccaataccgcccaacagcacaataatcagaaaacccttacctctcacgcggcctccgttctcacatcccataaacattatggcagaagcccgcgaaacccgcgttttgtcgtggtaatgtatacgctttgcattcgatggaatgggtttttaagatggcgaaattgcgggtaggaatagtatttggcggtaagtcggcggaacatgaagtgtctttgcaatcagcgaaaaatatcgttgatgcgatcgataaaacccgcttcgacgtggtgctgttagggatagataaggcgggacaatggcatgttaacgatgcggaaaattatttgcagaatgcagacgatccggcacatatcgcgctacgtccttcggcaatcagtctggcccaggtgcctggcaaacaccaacaccaattgattaacgctcagaacgggcagccgctaccgacggtagatgttatttttcctatcgtccacggtacgctgggcgaagacggctcattgcaggggatgctgcgcgtcgcaaacttaccgtttgtcggttcagacgtgctgagctccgcagcctgcatggataaagacgtcgccaaacgactgctacgcgatgcaggactgaatatcgccccgtttattacactcacccgaacgaatcgtcacgcgtttagttttgccgaggttgaatcccgtctgggactgccgctgttcgttaagcccgccaatcagggctcttcggtcggcgtcagtaaagtcgctaacgaagcgcaatatcagcaggcggtcgcgctggctttcgaattcgatcataaagtggtggtggagcaagggatcaaagggcgcgagatcgaatgcgccgtattaggtaacgataacccacaggccagtacctgcggcgaaatcgtactgaacagcgaattttacgcctacgatactaagtatattgatgataatggcgcgcaagttgtcgtgcctgcgcagatcccttccgaggtgaatgacaagatccgcgcgatcgcgatccaggcttatcagacgctggggtgcgcgggtatggcgcgtgtcgatgtcttcttaacggcagacaatgaggtcgtgattaacgagattaatacgctgccaggttttaccaatatcagtatgtatccaaaactctggcaggcgagcggattgggctataccgatttgatcagccgcctgattgagctggcgctggaacgccatacggcgaataacgccttaaaaaccacgatgtaatagcgcacgcccgatagcgcaacgtttatcgggcgtcttttacctcatcatcttcgcgccggcgaatgatgaaccccgccagccagaagctgataatccacgttaccagcccaacgccataggtttgccatcctttcgcctcaaaacccagcaatcctacgacgccattcaaaataaagataaggccaatagagaaggcatagtagtgccagtcacgacgaatttttacaggcaaacgcataacgactccgacgtattaacagcaacaaaaacgtatttttgcatacttctggcgagcgagtctgtgggggatacggaatttcttaaatgttaattgattttgataaaagtgatcgttttgtgacaactaacaaaaatttacgcgatggatacattccatatgtgaaattaccatgattctgatattgacaaacacaatgacctgtcagacttcacagtaagccgatggcataacgccagatcgtagccgatcatcctggaggtctttatggctgatttcactctctcaaaatcgctgttcagcgggaagcatcgagaaacctcctctacgcccggaaatattgcttacgccatatttgtactgttttgcttctgggccggagcgcaactcttaaacctgctggttcatgcgccgggtatctatgagcatctgatgcaggtacaggatacaggtcgaccacgggtagagattgggctgggcgtcgggacgatttttggcctggtgcccttcctcacgggctgcctcatttttgccgttatcgccgcgtttttacgctggcgtcaccgtcaccaataaaccttagcgcgctggagaaaatatcccagcgcgaaatttatcgccccatacaccgcgcccgccgctcatcaactcgtttagcaaaccaggcggtcgtcagcttacgcgtgatcttcggactttccagttgaataccgggcaacatttcccgcgcaagcgtcttgcccgttttggcctcggccagcttatagactttcttgtagagcgccgttttttcaaacgccaggttatcgcctttctccagttggctgcgaatttcacgctcactcattcccaactgccctgccagtttgcgcaccgctaactctgttttgcccggttccttgctgttataacgaatcagatcgccatccagcgccagttttaccccactggctttactgacggcattctggaacgcagcgttacggctggcgtaccatcccgcgttgaagtcggcgaagcggaaaacaggcgcgctgtagttcgccgggtaattcagcaaatggtaggttccaaaccacaatccgccacggcgcgtaaagacctcctgacgtaccgtacccgccatattccacggataacctttcgcgtgctgttcggcaaaggcaatgctgacctgcatcgggccgcccgtatgcaccgggttatatgagccaaatagcgtctgccccatagggaccatattgataaagtcgtcaaaaatagcgctaagctgtttttcggtttttaccgtgtccaggcgttcgctatagctcttgccgttgggggagttaattttcagcgcggtgtgcaccagaaacagcggaatgtgtagtcgttcagcgcggcgatcaatctcctgccaggcgattttacttagccccggcacgacaggatccgcctgataaccggactcctgctgggcgacagccagcaccgaacagatattttctaccgtcggcgccagcccctggctcttaaacgttgtcgcgatatctttcgcccaggcctctctgtctttgacactggccggcattttctgacgtactacgcttgccacgtcgacaggcttctcgcccttgctcaccggctgcccggattgactactacagccagccaatatggcgaccgccagaaaaggcagaggataaagacgggacgccgccgacataacgtttccttctgttagctaaaagagtgggtcacttcctgaactggctgaccatccaactggcgttcaaagctacgtaaacgtttataaatagacatcagctccaccagagtcgtccaggagttaatcaaatactggaacgaaccgcgcacctgaccaaacacgttggtgatttgcgtcatcagccccagcgtaatcgtaccggcaacaatggaaggaaacagcaggaacaaaccgaaaacgttatcgacctgcaaatagagaatgcgcgcgatgttgaaatacatatagtgaaagtagagacggaagtagttatggcgcaccgcgctaaacagttcacggacggtgggcggcgtggcgcggctggcgtcatcttcaccgtagaccagctctttacgataagctgcctccactcgctgatttttaaattccagccccgacaatttgatcccgacgaccgccagcaggcccgtccccattaatgaccagactatggcggcaatgaccaggccgtaagggatatgtcctacgatgggtaaattcggcacatgcgctgacagggtgaccaacaccggcagaaaggcgataagcgtcatgatggcattgataaaactcacgcccatgttctccagtgtagaggcaaaacgcatggtatcttcctgcacacgctgggcggccccttcgatatggcgcaggtactgccagtgcgccatatagtgctcattcattgcggtacgccagcgaaatacatagtggctgacaaagaagttgttcagcacgccgatcaccacggcgataagcgcaataccgagaaacacccccacttcatgataaaattgaccaagagtgaccttgtgcggcgagttgagcgccgtttgaatcaaatcatagaatggcgcgtaccaggcgttaaccgcgacgccaacctccaccaaaaaccaggtgacaaaaataatgagcgaggtgccaagtatcgaccagtactgccagcggtgcgggctatagatgaaccagaacgttgcaaataatcccacgcaaatcaggtaataagcataaaaaatcagatagtccagcaaccagaagcgcgctgcgctgataggcacttcatcggatgcccctacaagtcgcgccacccaatctcctcctcccgcctgccagaaaatgacagcgatcagcgcccaaacaaacgccgacatgaaaaacggccctggctttgggaaaaaagatttaaacatcatgctctcctgctaacttcttatctttattacggctgctgtgacggcggcaatagcacgccatgcccacggctaaaccaggcattgtgacctacgttgtgacgcttagttcgcatttctgctcaacagaattgtttcgacgagtttcatactcagcaggcacgctgacgctatcaggttatcacaagcgctttatcacaaaagtaaacattctccatcacgaaaacccgccgttacgttttttcacccacttttttctctttaacgttttgcaatgtgccgccgggtagtataaatacgcataaccaccgttatttcacttatggacatcaccgttgaaacgtagtctgctttttactgccatgctgtttgcggcatcacttacttctgtccaggcggctcagccgattgccgatccggtttttgcctctgatatcgttgatcgttatgccgagcatatcttttatggtagcggcgccacgggcatggcgctggtggtgatcgacggcaatcaacgcgtgtttcgtagtttcggtgacaccagaccgggcaataatgttcgtccacagcttgactcggtcattcgtatcgcttctctcaccaagctcatgaccagtgaaatgttggtaaaattgctcgatcagggaacggtaaaattaaacgatccgctcagcaaatatgcgcctcccggcgcgcatgtcccgacgtatcaaggcacgccgattacgttggtcaacttagcgacccacaccagcgcgcttccgcgagaacagcccggcggcgcggcgcatcgtccggtatttgtctggccaacccgcgaacaacgctggaactggctctccacagcaacgttaaaagtcgcgcccggttcacaggcggcctattccaatctggcgttcgacctgttagccgacgcgctggcgaccgcctccggcaaaccttatacgcaactgtttgaagaaaagattacccgcccgctgggaatgaaagacaccacgtttaccccctctcccgatcagtgtaagcgtctgatggtggcagagaaaggcgcaagcccctgtaataatacgctggctgccattggcagcggcggagtctattctacgccaggagatatgatgcgctggatgcaacagtatctgtcgtcagatttctatcaccgtagccatcaggccgatcgtatgcaaacgttgatttatcagcgcgcacagttaaagaaaatcatcgggatggacgtaccgggtaaagccgacgcgctcggtctgggctgggtctatatggcgccaaaagacggacgtcctggcattatccagaaaacgggaggcggcggcggttttattacctatatggcgatgatcccacaatataatattggcgcttttgtggtcgtaacccgttcccccctcacccgttttaccaatatgagcgacgggattaacgatttggttactgagctaagcggcaataaaccgattgctattcctgcatcctgagtcgtcgcgcctcgcgctatatcagacgaggcgcgacatttttgttaatattcggagggcaaacggttaatactgatcaatttgcctttattcatttcaatgtaattacccttacgcagggccgcgagaacttccgccaccaccgatcgcgatacgcgcgttcgttgatgtatataattcataacaccaatacgtgagcgaagttcttcatcccactcaatcattgtcattaacgtcgcacgaatctggtcgtaagaattattaccaatgagctgcttgtcacgaagctccagtacctgacttttccatactatccaacagaaggcttcacgccacagttggttctgctcaatgatggcgagagtttgtgatgatgagaggcgataaccgatgcaaccgctctccgcaattaatttatattgtgcctcttttttcgccacgccatcggctaagccaaaaataaaaggggcctgcacaataccaataagaactttatcaccccgaactaacgaaacaaccccctctaaaataacaaaggtatgggtattactttcatcaggtgaacagataatctctttatcgttaacaaactcgaaacgcgtaccatgcttagaaaggcatttatcgagtctgttgaattcctgtagtggcttgtttaaagataacatatgcattccttgcaataatgcccgtcaagtccttgacgggcatttttcagtttaaattacttttatttctcctgagagaaaatgattaccaggtatatttaacaccaacgtttgcagaccagtcttgatcaacatcaccgccgccgaggtagttagcatcggtgtaggcgctgaagttcttcgtgaagctgaactgagtacccagaccaacacgtaccgcaaaaccttctacgccgttgtcgatagagtcgccgtttacgtcagcatcgttgttggagtcgtcgtaaacgtaagccagtttgaagtacggggtcagcgcctgatcttcgctgtaagtgaaggtataacctgcatctacaccgagttcataacgcatgctgtcgtaagactgaccgtcaactttcatgtcgttgctcagctggtagtcgtcgccggactggaacagaccggatacgctgccgtaaggcgttacgtagcctgcatcacccagcttcagatcataacccagtttcaagccgaagccccaggcgtcagaagaggtgttgccgtcaacgtaagtaccgtcgctcatgttagcagacaaatcgttgttgaagtgagagtagcttaagttaccgtcaacaaagatgttgtttgcgaaacgagcggaagagtagatgtaggcagactggctgtcctgatccacctgaccggtacgatcgctcagatcgcctttcgcgaagcctgctgccgcaccaacgatccacttagcgttgttaccgtcaactttggtatcaacaccgaccatgatgccattaacatcctgatcgtagttaatggtgccgttgtcgccgttgaagttaccgccgaagtagcttacccatgcgccgccgttatccgccaggccatgacgagcgttggtcagacgagtaccaacggtgtcttgttccaggttccagatattggtgttcgcagaaggaatgctcagcgccatgttagcgtagtcggtcagttccatctgttccagcacgacagtgttgccttcctgcttagcctgataggtgtaagcacccaggtcagctttgtttgctgcagagaaggtagcgtcggtgtttatgtcattgacataaatcagctcgttacctttgtaatccgcaacagaaccggcaccagtagcgttgtcgatgcgcactttataattaccagtggccgctacaacgttgtcagtggtgctacttgcatcagcctcgtcaccattgttgatatcgccgttaccgttgatagtcagatgaccatcagagttcatcgcgacaacgccgtaaccgtagttagcctgagtggtatcccaggtacggtcgttcaccaaatcggcatttagggtatagtcattgctatgaatgttgaacacaccagcataaacattgccattattatccgcaacgttactgctagtcagttctaacgtatcagtatcaatgacgctatctgcgtttgtattgttggtttgaatatctaacataccaccgtgagttacggtaatagtattagcatacagtgcatcatcactccatgcactgctgacatcatcagccaaagtaactgtactgaaagtatcaacggtcaggtgatcagtatcaacgtagccaccttccccgatgttcatagctgaaccaccgtttagagtaatggtatcagcggttaaattggagccattagcgacatcaacctgagagccgctatttactgctaaggtatctattacagatgtttttgtggtatcccactcagatccattattcaagctgacgtcaaagataccgctctggaaggaagcagcactattaacacgtccccaggcatcataattagtcgagtctggatctaagctattggcatcaacatcatagaattgcactggatccattgactgtgaatcattaaccgccgcaccaacccatttagtgttattcagggtcaatgtcaggtgatcaacgttttgatcatcatctgcccaaccaccattcgtatagacagtagtggaatcatcgactaaacggccattagaatagaaattataattccaggagctctcaaggacgacatcccccagtaactgcgagtcggtaaacgtaacgttgtttaccatacggtaatttgaataaggatcgtcaacaaaagctaaagcaacatcatctttattccaaccattgccattataatcgcttggttcacttgaattgccaaaatggccttgttcctcatcttcggaccaggagcctgaagttacagttgaattcgctacgttaatagtgttatcccactgatgtgcttcggttgtatatgttgaattgccaagatcattttggtaaagagcaataccagccacatgagaattgttagtaatattaatattactttcaacatcaagggttatagcagtgcctaaaccagcagtaaccaatttgtcataatcggttttgactgtttttccatcagaatcgagataggtatcagtgaagtaaaacgcctcaaagtcatcatcgattgtagaattagaaatgtttagattaaaagtatcatcatcaacccaatcatgggtcgtataatcactaccgttagtccaaacatattgaccgtagcccatctggtaagaagtaatcataccatgaatggttgagttggtaacatccaatgtattcgcagtatcattggcgtaatcatgattcagataataagttgaaataacgccatttacagtgtcaccagtaaattttgtatcaaaatagccgctatcactagctggggtgttgtagacataaccaccataagttagatagtcatggtcgttggtatcatcccagccaaaaacagtggccgcatcgtcatggtacccaaaagtatcgtatgtagtagcattcgcctgagaagtgattgccagagtgcaagccaatgctaattgtgagactacaagtttctttttccaggagtgcatttgtcatccctcctcagggacgtaatatagttgatccatcaattatcaatgcataaaaacatatagatgtttagcaaggaggattatgcggcgtcattgctaaaaggttcaattattctttatcctcagtccggattcggacatgaattaaaaaggcgtaataaaaggaaagttgataattaaaaagcgttctttttcatgaccttgcaagaaaataaaaaaacaaaatacatataagataaatatgaattaaagaaaaacaaaataaatatgaataatgtcaaaatccacatttacttaaatgacgatgaaataaaactaaaaacaacgtaaaactaattcttatttaaaatgatatagtgcctgatgtattaatcttcggtatataaaagaagcgccatgttctgccgccgccggggctgcgcctgctacgttaaggaccgttttcgtaaaacatctgcctgcagattcaggtatactgggccttcgattccacaaacatcaggcagaccatgacagaccttatccatcgccctcgccgcctgcgcaaatccgctgcgctgcgcgctatgtttgaagagacaacacttagcctgaacgacctggtgttgccgatctttgttgaagaagaactcgacgattacaaagctattgatgccatgcccggcgtaatgcgtatcccggaaaagcagctggcgcgagagattgaacgtatcgcaaatgctggcattcgttccgttatgaccttcggcatttctcaccatactgatgacaccggcagcgatacctggaaagaagacggcctggtggcaagaatgtcccgcatctgtaagcaaaccgtgccggagatgatcgtcatgtccgacacctgcttctgcgaatacacctcgcacggccactgcggcgtgttgtgcgaacacggtgtggataacgatgcgacgctggccaacctcggcaagcaggccgttatcgcggcggcggctggagcagattttattgcgccctccgcggcaatggatggacaagtccaggctatccgccaagcgctggatgccgccggttttaccgatacggcaataatgtcctactccaccaagttcgcctcttctttctacggccccttccgtgaagcagcgggtaccgcgttaaaaggcgaccgcaagacgtatcaaatgaatccgatgaaccgccgtgaagcgattcgcgaatcactgctcgacgaagcccagggcgcggattgcttaatggtgaaaccggccggcgcgtatctggacgtgctgcgtgaaattcgcgaacgcacagagttgccgcttggcgcttaccaggtgagcggtgaatacgccatgattaaatttgctgctatggctggcgccatcgatgaagaaaaggtcgtgctggaaagtctgggctcgattaaacgcgccggcgccgatttgattttcagctacttcgcactggatctggctgagaaaaatattctgcgttaattctgttacagggcggcgcgctgccgccctttcccgactttacaccccactattcagtcgctgagtctaacccgttgccggacgcggcttatccggcttacggctattcctcgatcgcctggcgaatttgctgcaacgacgcgggatcgtcaatggttgtcagatcgcccggatcacggccttcgcagatcgcctggatcgtgcggcgaagcatctttccggaacgcgttttggggagctgcgaaacaaaccagacatgcgccggacgaccaaagtgaccgatctggttatccaccagcgccataatcgctttttcctcgtcgcgcgccgcctcgcgatccgccagcgtatcgctctgcttcggaatgacaaacgccaccgccacctgccctttcagagcgtcttttatccccaccaccgccacttccgctacgttcgggtaaccggagatactttcttctatttctcgcgtccccagccgatgacccgcaatattaatcacatcatcggtacggcccagaataaagtaatacccctcggcgtcgcggattccccagtcgaaagtggcataaacctgacggttaaacagcgaccagtaagtcttcacaaaacgcgcatcgtcgccccaaatagtctgaatacaacccggcggcagcggcccttcgatcaccagcatgcctttttcatttatgccgcagggttcgccggtgacttcattgagtagctggacgttataaccgtacatcggcaccccgggacttcccagacgcgacggcctgtcgtccagcgcgcgggccagcgccatgatcggccagccggactccgtctgccaataattgtcgatgaccggtacgcccagcgtctccgtcacccaactggccgtcggctcgtccagcggctcaccggccagataaagcgcctccagcgaggagagatcgtgattgcggatttgcgccgtcgggaattttttcagcacgcgaatcgcggtcggggcggaaaacatccggttaacctggtatttctcgacaattttccaccagaccccgcagtccgggtacgtcggcagtccttcgtaaacaatagtcgccatgcctgccagcagcggcgcgtaaacgatataggagtggccgacgacccagccgatatccgatgcgcaaaagaatacgccgcccgccttgccgccaaaaatggtgtccatcgaggttgccagcgccaccgcataaccgccgacgtcgcgctggacgcctttcggtttgccggtagtgccggaggtgtaaagaatgcacgaggtttcattggattccagccacgccaccggcacgctcgcgccgagatactgctggcgcaacgtggaaaaatccagatcgcgcccatccacccacgacattttcgccagccctctgtccaccagcagaacgtgtttcggctgatgctgcgcctgcgcaatagcgtcatcaagcagctttttatacggcagaattttaccgccacgcgctccggcatccgccgacacaatcagcgccggtctggcatcgtcaatgcgcgccgccacgctgtgcgaggcaaaaccgccaaagaccaccgaatggatcgcgccaatgcgcgcacaggccagcagggttatctgcgcttcggcaatcatcggcatatagaccaatacgcgatcgccacgctgcacgcccagcgacagcagcatagcggccacagcgttgacttcatcatgcaactggctgaaggtaaatgtgcgctcttcatcggtctctgatgagacggcaatcagcgccagcgcctccggctgtttatcccgccagcggtcgacggcgttatgacataagttagtggtgccgccgcaaaaccagcgggcaaacggtggacggctatgatccagcgtctgcgtaaacggctgtcgccagtcgatacgccgggcctgctcggcccagaacgcctccggttcgttaatggaacgctgataaaattcgctaaaagacatcacgctctcctgttgaacttacgccttactgctggctggctcagatgatatataaatcgaggtattcgttaaccggcatctgctccaggcgggctctgtccagggagacatccagaatgcgttgctgctggcgagtcgggaactgacgcgccaggttaattttaaatttttcgataagcttcggaataccgtcggcgcggcgacgcgcatgaccaatcggatactccacgacaacctcgccaaagcgtgagccatcagtaaactccacggtgatcgcattgccgatagcacgtttttccgggtcgtgatagtcggcggtaaaagccgggtcctcatagcacacgattttctcgcgcagggcgtcaatacgcttgtcctgcgccacctcgtcttcataatccgccgcggttaaccgtccgaacagcaacggcacggcgaccatatactggatacagtgatcgcggtccgccgggttattgagcgggccttttttatcgataatgcgaagacaggcttcgtgggtgcggatagtcactttctcgatatccgctgccgttttgcccgcggcctgcatctgctcatacagtgtcatcgccgcttcgacggcggtttgcgagtggaattctgccgggaaagaaattttaaatagcacgttttccatcacgtaggagccgtaagggcgctggaaacggaacgtttcacctttgaatgaaacgtcgtagaagccccaggttttggcggtgagcgccgagggatagcccatctcgccggttttcgccatcagcgccagacgtaccgcgcgcgaagtcgcatcgcccgccgcccaggatttgcgcgtaccggtattcggcgcatgacgataagtgcgcaacgactgcccatccacccacgccagcgataccgcgttgaggatctcatcgcgcgtcagccccagcatttcagcgaccaccgcggtcgaggccactttgaccagcagcacatggtcaagcccgacacggttgaaggcgttttccagcgcgatgcagccctgaatttcatgggctttgatcatcccgctcaatacctgtttcatggtcagcggcgctttgccggcggcgacggcgttgcgtgacagccagtcagccgtcgccagaataccgccgaggttatcagaaggatggccccactcggcggcaagccaggtatcgttaaaatcgagccagcggatcatcgcgctaatgttaaaggctgcctgtaccggatcgagctggaactgggtgcccggcacgcgtgcgccgttgggcaccaccgtgcctggcacgattggcccaagcaattttttacaggccgggtattccagcgcttccagaccacagccgagcgtgtcgagcaggcagtaatgcgcagtgtcgtacgccacctttgaggtgatctcgtaattcataacgtaatcaacgatatcaacgatttcacggtcaaagtctgggcgaacgttcgaaatatgtgcggacatagggtacaactcctgtttttatatttagaggttttaattagcaacgcttttcgatcggcacaaatacgcgatcttccgggccggtataattggcggaaggacgaataattttgttgtcctgacgctgttcaataatgtgcgccgcccagccggtaacgcgggcgatgacaaacagcggggtgaacatttcggtagggacgcccatcatgttgtaggagaccgccgaaaaccagtcgagattcgggaacatctttttggtctcccacatcaccgtttccagacggtcggcgatgtggtacatcttcagcgagccgccttcttctgaaagctgtttcgccacccgtttgatcacctggtggcgcgggtcggcgatggtgtaaaccggatgtccaaagccaatcaccacctctttgttttccacgcgtttacggatatccgcctctgcctcgtccggtgtttcataacgctgttgaatttccagcgacacctcattcgctccgccgtgtttcgggccgcgcagcgcgccaatcgcgccgataatcgcggagtagacatccgagccggtcccggcaattacccggctggtaaacgtcgaggcgttgaactcatgctcggcgtacagcaccagcgaaatatgcatcgccttttcccagctttgggttggcttttcaccgtgcagcagatgcaggaaatggccgccgatggaatcatcgtcggtttccggctgaatacgttcgccgttgtggctgtagtgataccagtaaagaaggatagagctgagcgaagccaacagcttatcggcaatatcgcgcgcgccggagacggtatgtccctctttttccggcagggtgcagcccagcgcggaaacgccggtacgcatcacgtccatcgggtgcgaggccgccggtaacgcttccagaacggtacggacattggcgggtaatccgcgcagcgcttttaacttgcttttatacgcgttcagctcgtcgcgggtcggtaattttccgtggatcagtaaatgcgcgacttcttcaaattcgcagtgctccgccagatcgagaatgtcgtaaccgcgatagtgcagatcgttaccgctttttcccacggtacacagagcggtatttccggcaggtacgccggaaagcgcgaccgattttttaggcttaatgacatgcgtgttgttttgcaggatcgtcgtgtctgtcatattgtcctcgtcattattgtaatgtgtagggtattgaggcgtgtaggccgtaccgtaggcgggataaacgtagtgccatccggcattgcctgatggcggcttcgccttatcaggcccacaggctacgattttttattcctgtacagcgcgtccagcttctcttcgaactggtagtaattgatgctttcgtacagctcgttgcgggtctgcatgatgtcgatcacgttcttttgcgtcccttcctggcgcagcacggtatagactttttctgcggcgcggttcatggcgcgaaacgccgacagcggatagagcgccatcgccacgtgtgcgctgcgcaactcgtcggtcgtaaacagcggcgtcgcgccaaactcagtgatgttggcgaggatcggcacctgcgccacgtcggcgaactggcggtacatcgacagttcggtgatcgcctccgggaacagcatgtcagcccccgcatccacgtaagcctgcgcgcgatcgagagccgcctccagcccttccaccgccagcgcatcggtacgcgccatgatcacaaagttcggatcggtgcgcgcatccactgccgcccgaattctgtctaccatctcctctttcgagacgatcgctttgtttggacggtgtccacagcgcttagcgccaacctggtcttcaatatgcagcgcggcggcgcccgctttggctatggactttaccgtccgcgcgacattaaaggcggaggagccaaagccaatatccgcatccaccaacagcggcagcgggcaaacatccgtgatgcgccggatatcggttaacacatcatccagcgtcgaaatccccagatccggcagtccgagcgagcccgccgctacgccgccgccagaaagatagatagcctgatacccggcccgttgggccaacagagcatggttggcattaatagcgccgacaatttgtaatggattctctttagcgagcgcggcgcgaaatgcctgccccggcgaatgtaaagacataattcgtcctcatgttagtaaattgttattcaagatgtattcaccaaagcaaaggctatgccaggcaaagaggcagcgagaaaattaaatacaatgagatttaaaaacaggtaattacagtcattcctgttatgaataagcgcgattaagggaaaagaaaaacgtgtcagctaacgtttcatgaaacgaatcgctccgtttcattgcaacatttatgaaacacgtttaaaacaaaaaatcgccccttaaagatgaacctactgcgatgacgactgctcacagcgctccgcgcgataatagcgataaaccggtgatctggacggtctccgtaacgcgtctattcgaactgtttcgggatatcagcctggaattcgatcatctggcgaccatcacgcctattcaactcggctttgaaaaggcggtgacctacattcgcaaaaaactggcgaccgagcgctgcgacgcgattatcgcggcgggttcgaacggggcctatttaaaaagtcgcctgtcaataccggtgatcctcatcaagcccagcggattcgacgtattacaggcgctggcgaaagcgggaaagctcacctcgtctatcggtatcgtgacctatcaggagaccattccgactttacttgcctttcagaaaacgtttcacctctgtcttgaacagcgaagctatgtcaccgaagaggacgcgcgcgggcaaattaacgaacttaaggccaacggtattgaggccgtcgtcggcgcgggattaattaccgatctggcggaagaagcgggtatgaccgccatctttatttattccgcggcgaccgttcgtcaggcttttcatgatgcgctggatatgacccgtctgacacggcgccagcgcgtggattacccatccggcaagggattacaaacccggtatgaactgggcgatatacgcggccagtcgccgcaaatggagcagctccgccagacgattacgctctatgcccgctcccgtgcggcagtgctgattcagggggaaacagggaccggaaaagagctggcggcgcaggcgattcaccagacgttttttcaccgccagcctcaccgtcagaataagccatcccctccctttgtcgccgtcaattgcggcgcgattaccgagtcattgctggaggcggaactgtttggttatgaagagggcgcgtttaccggttcacgacgaggaggccgggcggggctgtttgaaatcgcacacggcggcacgctgtttctggatgaaatcggcgaaatgcccttgccgttacaaacccgactcttgcgcgtactggaggaaaaagccgtcactcgcgtcggcggacaccaaccgatcccggtggatgtccgggtgatcagcgctacgcattgcgatctggatcgggagataatgcaaggacgttttcgccccgatctcttttatcgcctgagtattctgcgtctgacgcttcctcctttgcgcgagcggcaggctgatattttgccgctggcggaaagctttttaaaacagtcgctggcggcgatggaaattccgtttaccgaatcgatacgtcatggattgacacagtgtcagccgcttttgctggcctggggctggcccggtaatattcgcgaactgcgtaatatgatggagcgcctggcgctttttttaagcgtcgatcccgcaccaacgctggacaggcaatttatgcggcagttattacctgagcttatggtgaacacagcagagctgacgccttcaaccgtggatgcgcacacgttacaggatgtactggcgcgctttaagggcgataagaccgcggcggcgcgttatctggggattagccgcaccactctgtggcgtcgtttaaaagcaggtgccaaagaccagtcgggtaattaagacaaatgacagcgtcctgaatgcctgatggcgctacgtttactgcaggccgtcatccggcaaaacggatgccggttgccaggaataaaaatacccgccggaaacccaggcgggtatttttatgatgcaacgcttttatttctttttataaatatcagccgtaccatgaattttattttctgtctgcccggacgtcagcaccaccacatccgcccctttttcatccgcctttttgattaaatcttctctggcgtccagcggcgacatttccccggtggtggaaatcgtgccaattttcgtgtattcggaggcgactttatcaaagtccgtttttttcatgatttctgcggcataaacgtttgtcacgacaaacgctaatgcgccaagcataaccttgtagccagttttcatagcaaaaccctcgttttattattacgccatcatcgctttatcagaacaaaaaggccgttcggactgattaaataagtagtgtagattgctggaaaaatccagtcagcccccgctcactcggcataacgacgcggattaaaacgcccctgctttgtgatctcactcgcaatcatctggtttgactattaataagatgaacgttatttcttgaggctatgggaagagttgtctatggagccgtttcatgccgttgtgcttaccgtcagtctgtttgtgttaaccttttttaatcccggcgcgaatctgtttgtggtggtgcaaaccagcctcgcatcaggacgccgggcgggagtcatcaccggcctgggcgtcgccacgggagacgccttttattccgggctggggcttttcggtctggcgacgctcattacgcaatgcgaagcggtattttctcttatcaaaattgtcggcggcgcctatttattatggttcgcctggaacagtattcgccaccaggcgacgccgcaaatgagcacgctccagacgccgattgccgccccgtggacaattttctttcgccggggattaatgaccgatttatccaatccgcaaaccgtactgttttttatcagtattttttccgtaacgcttagcgcagaaacgcccacatgggcaaggttaatggcctgggccggaattgtgctgtcatccgttatctggcgtatttttctcagccaggccttttcgctccccgcagtccgccgcgcttatggacgaatacagcgcattgccagccgtgttatcggcgccattatcgggatgtttgcgctcagacttctctatgaaggcatgacgcaccgctaatgtttgcccggtagcctttgctaccggacgataagcgttatcaaaacgcccatgacacgctgcctacaatgctacgctcggcgccaaaataacaataagagagcgaattacaggcagcgacatagcgtttgtccgtcagattatttacgttgagctgggcgctcaagccatttaacccaatgctggataaatcatacccaaccaccatgtcgaccagtgtataggacggcaacgtgtgggtattcaggcgatcgctggtcacgccgttgacgtaccggatgccggagcccaaagtcagccactctaacagaccgcttttcacatcgtagcttagccaggcgctggcctggttccgtggagcataaaccgcgcgcttcccctgctcttgcgggctacttttcttataacggatatcagtataggtatacgccgcctgcaaacggacgctatccgacaaatggctaatggcctccagttcaacccctttagactcaatttcaccaatcgagcggtacggatcggtaggttcttctttggtcgcgatattggtttggttaatacgatacacggcggcgctaaactggctgttcccccccagcggttcgtattttacccccgcctcccactgcttgcctttcatcggttccagcacattgccgttttcgtcggcgaagctggtcgacgtaaacgcggtagaataactgagatagggggcgacgccattgtcgaacagataaagcaacgcggcacgggtgctgacgttgtttttatcgagatcgctgcgtgaatcatgaagtttgtcgatgttagacacgctgacccgatcgtaacgaccgcccaacgtaaagcgccagcgatcccatgacatctgatcctgtaaatagtatccggtctgccgcagcttatgtttttcacggctatacaacgtaatgtaatccggctgagcgccataaacagggttgaaagcgtcaatcggcggaaacgcgccataatagccagtagtatgattactgcgatcctgataatcgatccccaccagcagacgatgattaatcgccccggtatccacgctgccgtcgagctgattatccagcgcgatagccgacattttctccccggagccggaatagccgcgattcagcgccgtttcattcaaccaacctgcggcatagacctgattcaacgtcactttggtatgcaaataacgcaatttttgccgtaccgaccagccgttatcgaacagatgctcaatgttataacccaccatattttcacggcgatcgtatttgtcgtagtcatcttcaccttcaaagaaagtgttagaaatttttccgccgttataaggtacaaccgtgccttgataaggcagtccggagtggctaccgccttgcggatcacggtgcagataggccataagatcaagacgcgtccgatcggtaattctccaggtcaggctcggcatcagcgcataacgttcctctttcaggggcgtaaactgcgaatcggcgtaacgtgtcatgccgctaagacgcgccgccacacgttcattgtcatccagtgggccggtcacatcaaaagccgccccgcgctggttgttattgccggcaaacagcttcacttctcctccggcatcaaacgccggttttcgcgacgtcaacgagacaatgccgcctggcgatgaacgtccatacagaacggacgccgggccgcgtaccacctcgatatcttccagaaaccaggggtcaaccaccaacgaactgtgcgaattggtgtcgcccatcatttttaacccgtcgagatagacgttatccagactaccgtccgaaaaaccacgcaatacgatgtaatcaaagcggttagaggcgcctatctggttactgtatacgcctggggtgtagctgaccgcctgacgcacgctggttgcgccctgctcttcaaactgctggcgggtaataatggataccgactgcggcgtttcaatatctggcgtcgccagcctggtcgcgccactctgaacgggcgaggtgacaatgacggtatcattttttgtggtttcctgggcaaaaagaggaaaagtcgcgccgccgatagctccgcctatcaatagcgccatacgcgttgtcgcaaacatgaacatctccaaaggcatctttattgtaaataagaattattaccctttagagataacgaaccactatgcgtaacgccagattgcctatgcgcaatgataaaaaatcacccaaagcggcagaaaaccgggttagcggcggatattaccgctctggcggggcgcgttacgcacagtggcgggacgccgtcagagacgcgtcacgcagctcgccgggcgagcagccataacgccgacgaaatgccgtcgcaaagttagtggcatgttgatagcctgacatccaggcggcctgctgcacgctgtatccctccatcagataacgacgcgcgcgcgccaggcggcaatcgcgcagataatcaaacacggtacacccataggcatggcgaaacttgcaccgcaggctactcggactcattgccgcccgacgcgccagttcgttcagcgtgtaggctttttccggcgtttgctccagtaaacgccgaatgagctccagccgctggtattcaccggtgacgggaagtccgcgtttttgcgttgcgggctgacatagatttaacgcatagcccagcaattgcagcatgatgccttccagcattaactggcgtgacgccgcatgaggtccgggctgctgcgcataacgtagccccgaaagcagaaactccggcacctgccagaccctcgccgaggccgcgctacgttcccactcgtctgccagcgagacaggcaaacgctcccgccacccgccgtccgggtacattcccagcgataaggtgcgcaatttactgtctgcgccgtgatgggcgcgtatcgtctgctgctcactcagttgcgagcaaaacgccatccccgcgctcaacaaaaaggtctgctcattgacagccagcgcgacgttaccttccaacaccaccagcatatacagcggactgctatggcgagaggtggtttcataaggttgtaacacgtgaacatccgagcgtgtaatgcaaatcccgccgggaagcgctatctcttcgatatcgccatgaagtacgggactactctgcgtatactgcggtaacgcagggaagcggtaatcaatgccataacgctcgccaaacgcgatgaagtcgctgacggaaaagatctttttcatcgccggggcggcggaagagtgacaggagatcggagacattatcaataccgtttatctgcgttataccagagcgttagccactgtgtaaccatatcactgcggcccgggaacgacaataaagatgagaataattatcaaccgctattgaggggagagataaggcgagcaaaggtgatcgataaacgccgatctgtcgataaaaacgcgctttcgcgagagacgaaagcgcgtccgggggtatcagtcaggagcgaaatcctgcggaggtcatgagcagtctgaacaacattccgacgcccgccagcagaagcacgctggcgcaccatatcgcgaccatccatacgactcgccgcgaccattttttcactttaaccatcagtgatatccctctccatgtcgcacttttccacggaagacgtagtagctccagaaggtataagccagaataatcgggatgattatcagcgccccaaccagcataaagctttgactttgcgacggcgcggcggcggcatacagcgaaatatccggtggaataatattcggccaaatactgattcctaacccgctgaaccccagaaaaatcagccctagcgtgagaataaatggacgcgcatgggattgtggttttttcacgctgcgccatagccagacgctaaaagccaacaccagcacaggcaccggcaggaagtagtataaattgggcagcgtgaaccagcgctcggcgatgtcgtcatgggtgagcggcgtccacacgctgacgccccccatcaccagcaacaagacgatcaacaacgggcgcgacagcgcgcacatccggctatgcagcggatcttcgcttttcataatcagccaggtagcgcccagcagcgcgtaggtgacgaccagaccgacgccgcagaacagattaaacggcgtcagccagtcaagctgcgaaccgctaaaggttcgcccttccacctgaaaaccgctcaccaccgcgctcaccacaaccccctgggcaaaggtcgccaggattgacccgacgataaaggatttatcccagaacgcgcgatgcgactcggtggctttaaaacggaattcaaaagcgacgccgcgaaagataagaccaagcagcataaccaccagcgggatagtcagcgcgtcggtgatgacggcataagccaacgggaacgcgccaaaaagcccggccccgcccagcactagccaggtttcgttcccgtcccataccggcgcgaccgagttcaccataacatcgcgatcgtgtttatcacgaataaacggaaacaggataccgacgcccagatcgaaaccatccatcacgatatacatcagcgtggcgaacacgataatagcaaaccagataaccggaagatcgatggtcattcgcgtttctcctgctcaagcgattctcccacggcagagataggacgcgcgggtctgccatcggtttcagcggtcggtgtctccgccggctgcggccctttctggataagacgaatcatataaatatagccaaccccaaacaccagggaatagaccacaaagaaggccagcaaactgatgctcatttgcaaggtgctgtgcgcggaaaccgcatcacgcgttcgcagcaggccatagaccacccacggctgacgtcctacttcagtcgtcacccatccggcaaggatggcgataagcccggacggccccatccacagcgcaaagtgcataaagggccgcgaatgatacaggcggcgtcggtagcgtagccacaggctggccagccccagaaagatcatcagtacgcccatgcccaccatcagacggaaagaccagaacaccacggtagggttggggcgatcctctttgggataatcttttagcgcaggcacctgtttgtccaggctatgcgtcaggatcagactgcccaacgccgggatctcaagcgcatagcgggtccgttccgcctccatatccggccagcctaccagcgtaagcggcgttggctcgccgggcgtattttcccagtgcccctcaatcgcggcgattttgaccggctgatgcttcagggtgttaaggccatgcatatcgccaatcaatgcctgaacgggtgccaccacgaccgccatccatagcgccatcgagaacatacggcggatagccggcgtatcgttacctttcagtaaatgccaggctgcggacgcgccgacaaacatcgcgctacttaaaaacgccgcaacggacatatgcaacaggcgatacgggaacgacgggttgaaaatcaccgcgaaccagtccaccgggactacctgaccgttatgaatttcaaatccctgcggggtatgcatccagctattagacgccagaatccagaacgtcgacattaacgtgcccaacgccaccatacaggtagacaagaaatgcaggcccggcccgactttgttccagccaaaaagcatcacgcctaagaatcccgcttccaggaagaatgcggtgagcacttcataggttaataaaggcccggtgatactgccggcgaactgggaaaaaccgctccagttcgttccgaactggtaagccatgaccagaccggagaccacgcccatcccgaagttgacggcaaaaattttgagccagaactgatagagcgagcgccagacaggattacgcgtttttagccataaaccttccagtaccaccaggtaactggctaagccaatcgtaatcgcggggaaaataatatgaaaagagacggtaaaggcaaactggagtctcgctaaaaagaatgcatcaaactccatgttccctcccgtttatatagtcacttcgtgtaaaatattcactgttcgcaaccaggttgaaacgaaacggttattttccccaaacgtaaaaacgtcggggaatatccagataaattacgattttttttgcggctggctgtcaggcttatcgcccgactctggcgcttcggaggggtcgtctttttcgacagcgaaacggtagtatctatttagcataacatgtctcccttagttacattcacttggcaatatctacctggccgttataaaaataacggcaaaacaaaaaaacagcgtcttcaagactatttgcaatttcagcaaaatacacttagctgaaagttaagaatagacgtaaaacgataaccttcaagtcaacgcggtttacgggacgggggattagcacaggagaatgaccgcaacgctcgctgcgcggcggccattttatatggcctatcaaaaagataaccgttaaggtctattcaaacccgttagtttgccttccccccaatcaagccattgatggtagaaaataccgccggcgcgctggtcgcttccgcaaactcgacattgatattttgccgacgcagcatatcgaagaatttacgttgcgcatcaagaataacctgatcgcctacgcgcatattttctgctttagtttcaaccagtaaataaacactgtcggcgtcctgacgctcaatacggtacacaaaatccggcgtagtagagccccccgtatatttggggatctgaatggcccgcttaggcagtttgccaaacacagaaacctgttgcggataatcgtattttaatagcggcaattctggatcgacgctgtcataacgcaacggcggtatttgatagagagaacggggatcgtctatcgcattctcatccacatttttccccacaatttcagcgctaatctcctctctgaactgccgtgccgtagaatcaaataccgacgttgaagcctgaaaatcgagaggcagataatcgtggcgctgcgcaaaatgcgcattaatccgcgtctgtaatgcgcgggtcatattgtccaacgagatctcgcttaaatagcgtgaatctccgtgcaaaacatcacgcagcatcgccattaacaccgggtgcaggacgttaatcggcagactggtgcgtaacgccagttgcttaagaaaatggccatatttcatgcccgccataaattcgctggcggctaattcgccttcccgctgcgccacttcaaaacggccattatcttcattcgataccagccgttgttgcacctggcttggcttctggcgtatatacagcgacggatcgcgcagcacctcggcggcaatctgttccagagaagcgccgctacgctcgaattgcagcatataacggcgggaaaactgctcccagatactgctaagttgttcccaattctctttgcgtaacctgactcgcagtcgggaggcgggcttattgtcacgaatgcgatccgctcgcacccgcgcctgcgtcagctcagggtagaactccagtagccacgcaaagccacttttggtttccccgttaagcgtgacgctgggtttaaactcattactccggttgatcagttttttatcatccagatcttccagcaaacgaagctccgtaaacgcaggatcgactttttgtcgctcggtgacgatgagtgtgatcatcgcctcatccagcttctgctcgttaagctgaactttgctgtcgcgattaatctcatcaaccagcatactggcaaacgctttttcatcataaccaatcagaaacgacagtcgggacggccactcttcctgatgaacgcgatggccgttttcatctaccggtagccgcaggccgcgccccacttcctgaattttgctcgactcgctaccggaagaacgtaatttagcaatgacaaaaacattcgggttatcccagccttcgcgaagcgtccattttgaaaacagaaagcggcgcgtttcccagttgccgtgatggtctgaaaaactgagcaacttctctttatttttcagaatatcatctacctcagcctggatcgcctcatcgccgcttccgcggtcttcgccaaagtaaccagcgtggacgttttggttatccgagtgcaggctggcgagcgtggcctgcagaaacgacagatactccacttctcgcggcagggtcttgcgctgataatcgtcaatcagttgcgtcagtttctttttcagtaaacactcaaacttcagtttcaaccaaccttcgtcatcacgatagcttttaatactgtcaataaagaaaaagcttaaggtcttaatacgcggggcattattttctggctcattgctgcgtaagaaatttgcctgctcagtgtcaaaatgcttatcgatagcgtcctgaataatcagttcctggtagctcgcgccaaaggttcctggcaccagcgccatccctgcctccagctccagatcgttcgacaacattttactgccggcatattcgatactgccttcaaatcctgcatcgacatcggcgagattttcgcccacgccaacctcggcaattttgctcccccgtcggaggattaatttctttgccgtgacgctgtcaacgatataacgattgttggcctgttcttcggggagattcgggtaataaatatcaatacctttcaccaaaccatcgttaaaactgtccaccgcgttgagatcaaactgcggttgccggcgatagtaatctttacgtacacatttatttttacccttaccttcgacaatatccgggaaggtagcgccaaagcggacgatcatttgcggctgaatggcctgaatcgctcgataaaatttgttatctcgcacaaaacgatgcggttcatcaataatgaccaccggtcgcgtcatttgcagccctttaacaggcgacgtcagcccgcccagtagcgttgatcgtaatcgtctcgcgtcatactggcggaattgagcatttgcgcattgatcagcaaaacctgaatcgtatggctatcacgacggctggcatcagtaaaacttaataactgggccggaaaatttttacgccccgactttactttaaaatcaccggcgttgatggtgcaaaattccatccgcgtattttcgtagaactgtgaaaaatgctgtctggcgtaatcgctggtgataaagttccgcgcgccttctttaatggctggcgtcggcaccaccagcacaaatttgaagaggccatacttctgatgcagttcatacatcaaccgagtatagacataggttttgcccgtcccggtctccattttaacgtcaatattggccttatcgtcgtaacgtcccttaatcagcggattagcatagtgattatgatcggcctgcgcgtgatcgataccggtgaaactcgccagaatcgccgctaacgcctgttcctgatggggaagttcttccagcaaaatattcatcatcatcccctcttaataacgcttcaccaggttcactttttgatcaagctgttttaagccgatttccagttcacgaatggattcaaggtcgaaagagtagccgtaaatgacaatggtctgaaccggaagctggtgcgtaccaatgtggttgagaagatcgcgggtctgctctgttccccatcgttcatcaatcagatacaggcgcgtattatcaacatacctggcgcaatagccggaaaaatcaacggtctgtacgtcaatatccattttataaccatcggcgaccagccatgtcgttaataaggtctcttcgccgcttgcgccgcccggcacgcccaatcctctggcggaaaaaggattgatcatgtcggtaaatcctgactcggtgaaagcggccagttgaccgctggtattgataaaatggccggtagcaatatcgaagctatccagatcgtccagcgtctgctgtgtcggagtggcaaaacgataatgtttaaaaccgagatcgctattggtcgcgggattgttggcgcggatcttcgccgcaacgcgtgtaattcgctcgcggctgatttcatcaatagtgttataacctgcttttttcgcgatagtgttattgcttaatgcctgatcgatagtacacagaataaacgtgcgctgccccccatcttcttcattcagcgccatcaccgcatgggccgtggtgccggaaccggcaaaaaagtccagaacgacgccgtctttatcgatagcgagcttgatgattttcttcaataatgcggtcggtttcggcgtatcaaaaacgttgtcgccgaagagatccagaatctcctttttcccctctttattcgacgctacgttatcccagtaattggtcgttggctgccctttactgtgatgcgcgtacatgactcgctggggaataccgccgttatctttgccaaaatagaccagattatcggccaccagtttttggtaactggcttcaggataagcccatagtctttcgtgtaccgtaccgttcggcgtggtaattttataggtatagccgccgccgctcagcccttttgacaccgttaacggcaccggtcgccatttcccttctggaaactgttcggtcggttctttataggatttctgaatatactctttagaaagcggttctaaacgtaaagcgccctgaccggttttggcgtaaacaagaatgtattccccctggatggaaacgttatcagagtcgttagaaatctcttttttgcgcttccacatcacattggtgacaaatccgccttcgccaaaaatctcatccatcattaatttaagattggcgtactcattatcgtcgatagagataaaaataaacccggtatctttcaggagcttcctggccaggaaaagacgcggatacatgaaagataaccacgcggagtgcgtcgatttaccctgaatggattttaaacgtgccagttcggtatcattaagaccaaacatatcctgcaacgcccgatcgctatattcaaaatgatcgggatagacaaacccgtccgatccggtgttataagggggatcgatatagatcatatcgacggtatcggcgtaattattttgcagatggcgtaaaacatccagattatctccggtcagaaaaagattatggctgtttttattttctgccagagtattgtgttccacgtcaggaacgataacggtaacggatttttcacccgcctgtttttttgcgtaatctttgccaataaaatcaatctgataaccgctagtcagctcatcaatattacgcgctttcagcgcgcgctcaaatttggcgagatcaaatccgcctttcgcgatcagttcgccctgctcgttatagcgatcggcgataaaaaattccggtaatgcacgttgtaactcagacagaaaggcgctattcggggcaacagactcgttgtgtttttggttatctttcaacatgatatcttcgctccgttgacaattttaaggtccaacaatcaatttcttataaagaaaaaagtaagcgatgattgtaatggtcacgaaaggcagatgccatcattaacctttgttgttcgttgaaagggcgtaaaaaccacaggaggaaggagcgctcccggcgacagtatgcgccaggagcgtagtgtttacgtgcgatgaccgatggccgactccgggagggcgtcgctatctgtaccggagatgacgactccccgggtctcgcgaccaaatgccacaaatacacagattaaaatagccaccgcgccagccacgatcgccattgccaacccgtaattgccaccatgcgtttccgcgatgcgggcctgtaacgtcgcattaaccgacgccagtaaattaccgagttggtaaacaaaccctggcagcacggcgcgcgcattcgccggaaccagctcgttcagccaggtcggcacgacaccccaggcgccctgcaccataaactgcatcaggaacgcgcccagaccaatcgtgaatgatccgctggaaaatgcccatagcgggagtaccggaagcgcaagaaaggcggcgatcatgatcgcttttttacgcccaatacgttccgatagcgtaccgtagaaaataccgccgagcatggcggcaatgttataaaaaattgcaatgatactgatcagatgcggatcaaaaccatgctgcatcttcaggaaggtaggatagagatcctgcgtgccgtgactgaaaaagttaaagaacgccatgaccagcaccagatacagacacaacttccactgtttgcgcagaacaggaagcagcgcggtattctctttacgcgctctggccgccagccagacgggggattccggcactttaaaccagatataaggcagcaagacaacaggcagggcgccaatcaggaacatgccacgccagcctaccatactgtagaagaggccaaaaataaccgaggcgaacagatagccgcagggatagcctgcctgaaaaatgcccgacatcaggccacgcgaacgatcgggaatggtttccatcgccagtgatgacgcgacgccccatatcccgcccatcgccacgccgtacatgacccgaaaaatcagaaatgccatgaaggtgggcgaccaggcggaaagcagttcaaacaccgtaaagaacagaatattgagcatcagtatcggtcgacgtccgtacttttccgccattcggccaaatagcagcgcgccaatgggacgtaccgccagggtcagcataatcgcaatggaaacctccgatacggaagcgtgaaaccattcggcgagatcgctaagtacaaagacaaggataaagaaatcaaacgcatccagcatccaactggtaaagctggcaaacgccacatgtcgttgtgtcgtcgtccagttcaggggggtgtacataggtagtgtcctgcatcaaaaataacatcaagctttgaagcggcgaaacgctggagcgctcccgtcgtcaaagcgacgtaacaaggtagcgttgcgctacttatttgttatctttttgtatatagcaggtaaaatgttagcaaaaatagacaaatcattacatattattaacaaagcttactggcacatgatttgtcacattttttatggggattatctcacgcaaagaaaagcgaagcgtggctagcgtatcgcgaccggcctgtcgccagaccgatcgccattgacgattacctctcgcgcggcgggaaaccggccttttgcagggcggcggcaatctgctccgcggatagcgacgtttcaatgtcaaccagacgcgtcgccgggtcggttctcaccgtcgcattagcatcgagagtcagaatcgtcttttttaccgtactggcgcagccgccgcaggtcatgtcatcaatatggaactgcatagtgaactccttttgtgtgggaactgttgccagtctgggccttgtcagtgttggaaggtcaagcgtaatctcaggacttacagacgctttgccagtccgtggcgacgaggacggcgcaataccgctccggtacgcgcctccgagtacaggctgcgcggcgcaaacgcccggataggcgcagcgcgcgccgccttcttcccgaccatcagcctgacaggctcggcgggaacggccagcgcgtctcttagcggactctttgaaccgggatcgggaagctggcgttttctaccgcaaatcaccttgcctctctttcacggcggcgcattacgcgctgacctggatagggcgcatgtccaaaaacagattgaaatcgcctggtatgaaaacgttattcagcaagcctttcgcgacgtggcggatggtctggcgggacagcgtacgctgaatgaccaggtgcaatcagaacaacgcgcggttgaagccagccaaatcgcctatgagctggccggactccgttttcaggaaggcgtcgatgactaccttacgctgcttgatacccatcgtatgctttatggcgcgcaacagcgtctggtacgcacacgtctcatgcaacagttgaatatcattagcctgtataaagcattaggcggcggttggcgggaatacagcgagaaaaagcaaggttagcccaaatagcgcgcgcgtcgccagtgcggcgcgcgcgctaaacaggcatatattgcctgcaaaataaggttaacgagggcaacgataaacgttcccgcttaacgtgacattcgtttgtttgcttgagcccgaaccgtgccatgaacttcctgtctggcctgcacgctgggttaacaggactaccgtattgtcgcccattttataagctttgtttttcagatcgttacgggcccccgtttccaggttactgttggaagtccagccaccggtaaagaaattcccctggctgcccgtgatatctcctaagtagctgcattccttacctggctcgctggtcatcacccgtacctgttcagcgccataattcagcgaattagcgctacatgcggttaaagccaagccgacgaaacatactaagatctttttcatactaatacctggtctattaatcattaaataataacgcgttcttgcttctgaacgccgtcaaggaactatatttaagatgtaacgaatgtctttcatttgctgaagaaaagtctctgtcatgatgctatcatgtatgcttgaggctatttcttgttcagttttttcaatatgctctctgagccttatttttgttttttcgtcaagcgccgagataagtatcttaatggcaagcagcaaagtaggattgatgctttcacactctctcatcgttaactttttcatcttgtttacttcaagcctgatcggcgtttttgtctacacggcaaattttagatgcgaagatatggcgacttctttggtaaataaatagcaaatggaaaaagcgcttgaagccatatttacgacagatacgcaatctatgaatgtacaaagtcttacgactaatgccatagctactggcgatctgactcatcgactttttatataaaaagtgccataacaactcttcctccttttttgtcaacggcgcaatttcaccgaccgctacatcgtttgcacaagcgtatttaatgaaatgctcaataaaaacaggctttgccaaatcgggatcgatatcaggatctctatcgcagccatgtggataaagttttccaatatctctgcgcgtgagccagattcgacgagcatgtggataatgctgcatgagcgccttaaaacctttccagaccccctgaatcaaaactcgtccatcaataataattatgatatcttcgctagctgatatctgacacgaattatattctccattaagtgggaacataaagcacttcccatcctcaaagagtgaagcgatgcctaaataagtataataatcatccgttaaaactatacctatcgtttttaacggaagttgttccgatagtgaatttataataatttcatcaatagaataacgctacggtgagtgttttatcttcctcttaagattacctgactgattataaccatccctactctgtagcaacgccatattatatttttagttccttgccataaacgtaacgcttatacttttaatatcagaagcgataacctacgctgacaccaaatgtattggtatccacagcgaagaaacggcttgcttcccatgatgcatcgatagatatactcttaacaggattaaatattacaccagcgccgtaggcaaaggactcttcttttgagtgtttattaaatttcatcgtcgctatacccgcattgccgtacaggctcacatagtcattaaagcgatatgttggtccaaacatcaaagaaccatagtccacagaatcggaaccatttttatgcaatttcccctctttccaggtgtagttctccatttcattgcgcgtcgcagtgaatgagcctaacatcccccaggtctcattgaactcgtaacgatatttaaaattaaagcctcgcagatctttgctatcgctatttttcaatgaactgagatgagtttgtgcataaccaaacgatacggtgtgctgatcgttagccaaagctaaaggtgacgctaataataaacctaaaaaaacaaggaacgaagaccgtcttttcattaaaaccactccatttttgatatataattaaggcggtaccggaacttatggcacacaaatagcatttagattaagagcacctaatgcgcttattaccagtcatgccaactgcggaggtaatataacctgatatattcgataatggatatgaaatcagtcttacagagttcttacttttttattaatagcggattcatagttgcttcagacccgatcctggcatcgcatccgtcaggcggactgcgagaggttatcagcgagtatcagttacctccctgtcgagtcaaaaattcataactcattgttttatatgcattttaattgattattgagttaacctttacccttgccgagggcaatttcgcaactcgctttctgacgcattcagacaacattcagatctactgcgcggtacaaacgttataaagctgccgattaagagaataaaaaaggttttctcacccactttagatattcgaatctcattagccgcttccggatgcagaacccgtaaatatgataacagatcgccagccgtgtccgtggcaaagacttttacctgggatacttcgaacgtataaacaccaggcgctgttcgatgtaaatttttcatatacacgtcccggtataatatttttacaccgttatcttttgtttttatttcatattgaagcgtaattctcttcatcttaaaatcaagaacaagactgccatcggcatggatatctttaggctgtatcgtcgttaccgttcttgtcgtacataaaaattcattagtattaatagaactatggttactgtttcgtacccaaactaccatcagtacgactgaaacagccaacataccaagcgtcgccacgcttaataacgttcttttatggaaatgcatttcggctccgctatatcaagttggttaagacactggacaaaaatatttgtattaggaacgcgaatgtaataaatgatttttccgttttgtttatgtatttcattactcatctcagagtacgcttcaatgatatccgccagatgggttttatcatgcccgacactataaaaagtgtatccatcatacgaaccattgagggtaaaataatcaatattttcacccttaactttataaatcataaaaaacatcagaagcgcggccaggcaaaagtagagccaatcttttctattcacagcgcccggtattgggggaataatagtatcatcgtgccgcacttcaaccgtcgataattctgtttcagcaacagcaggcaacggcatatcttgcgcctcatcactcaacggttcaatggaaactgagagtaaaacacccacgcgagggcgagtcacaacagactcccccttaagaccaattttatcaaatgatcctcgtagctggttaatcagtttataataactggcatcagagaccacaacacctttgcgcccccagacatagttaattaaatcatcttttttaaaaaggccttcataaaaagtgataagcaaactgcgttccgattcagatatcgttatcaactctccggcgcaggaaagcgtcattcgttcacaatcaagaataacccttttgtcaatcagataattgttctgactcataaaaatatccgccccagtgctatcacgtttcttcacggcataaacatattactaggatatatcgtgctattgaatttttttccgtagcgagttcctgcattattcagccaccagatcgctcgcggatccgctttcccccttgagcaaaccattttgccgctgggctgacttgccaagccaactcataaagtcattagtccccatcggcctggcataaagaaatccctgaacgaatcctaccccgtggcttaagatgtaacgcaattggtgctgggtactgaccccttcggcaaccacattgagtcccagtcgctgactcagcgtaatgatagtatccaggacaggaacatcatcgctgctggtatcaatggtatcgataaacgttctgtctattttaagagagtctacaggtaattgctggagataggagagggagcaatagccggtcccaaaatcatcaatcgctattaacacgcctttttcacggagcgttgaaagtttttctgcgacctgtgaaggttctacaatcaggctacgttcggtgagctccaacataagcgttatcgttcccaaacgagtcctgagcgcctctatatcttgcataaaaccgtcatccataagatgcgcaggcgatatatttacgctgatatagaaatcatccggtacagtccagtttatcacgtcatgagcaatcagttcgaacagatgacgagagagtggaataatcatgccttcattttctgcggcggtaataaaaatatcgggagttataaaacggccatccggttgcggccagcgcattagcgcctccacgccgccgcaactaccgtgtttaacattaaaaacaggttgataatgtaccgtaaattcattgtgcgttattcccctggaaatctcccgggccagagataagcgttttaaataccagcgcctgtagaacaatatcatccctacagaaagacataatgacagcggaataaaaataaaaaggttttgtaaccagtatgccgataacgttgagaaaggggttcgcaccatcagctggatagtgtgatcggttgaggtgaaccgctgcgttaaaaacgccttaccgcgcaacgtcgcagcgctggtaatcgcctctcctgcgccgaatatcaggctaaaggctgatgctctttctgcagccaatatctccatgagctcctggacatactgcgaatccacaatgacgaaagccgctttatccgctgctacttttttcacatacaccacaacaaggcgatcgggtccttcggccatactaccgatagatcgcaaccaccgttccggataagaagcaggtaaagaaagccctgccagccgggaaaaatgatagcgttcggttcctgtgacaaaggagcaagtgatatcaccattttccagaaacccaatgtcacggacataaggagtgaaggcccgcgttctggacagttctttcagcgtgtcagtacaggaactctcagccagtctggcggcttttccggcgacttgccaggaggcggcggatatatccgcgctaaaccgcagcagcgtattggcgctgacggcgatatctcgttttagctggaagatacccgcgagtaaccccaccaatatcattacgatcagtggaacggcaataaacaacatcagaaatagctttcttactttcaaatcattgccctcttaccggccttccttttgccactgtacgcttttataggataactaaagtaacattaatagagaaaagaaatattgagagataggttatacgttcttaatgatagcaagatggcactccctgtgccgaaaacagacaagagaatatcaatacccaacaggtgcaggatactatcgttaaaatgagcgataacagatatctaaataaagacgcattcaatatgttagcctgatgccaggttcactgcctgatgagacataaccatcacggaacgaattcccatcaatacagggattattggttacaactcaacgttactactggtggtacacacattatacaaatgccgattaagcgaaaacatgtaggtgtttttcccaattttgacaatttttagctcattaatcgtaccgggttgtaacaacctcaaccaggaaaataaatcgccagcagtatcagactcaaaggtcttaactgaattgactttaaaagtaaatgttttcatacccgttctgcgcagtttgctgatgcagatgtcacgaaaaaaaaagccgtttctctttcgtatcggtagtaacatcgtagtgtagggtaatcctgccggatttaagatccagcacaagtccaccatccatgtacaattttcgtggttcaatatacgcttctgattttgtcgtgcatataagattattggttctataagagtcacgatttacccactcaagcgctattaccgatccgattgcgacaatggcgataaatattacaaatataatcagtaacgttcttttactgtaatacattttggcaccgccatttcaacaggattcaagcattgcagaaaaatattcatatttggctccctgatataataaagatggcgtccattttgccggtaaattttaatttttagagagttaaaagcaaaaactacttcacttaatgtgaccttatcctcttttgttttatagattgcataatcgttatattcgccaagatatgtaaaaaaactatcagggctgttacgaacaggcgttttatagatagtaaatacaccatagaacaatgccagaagaatggctcctgttaatactacaaatacgctgtgacgtttaattttgtaaaatattttctcccgagtcgaggggcctttaacgttttcatcactcacctttagggaggtgattttttttataggttcaatggcaacagacagcgacacccccacccgagggcgagttacgatgccagatagctgtagaccgatgctactaaaatcatttctcatttgattaatgagtttatagtaacttgattctgagacgcagcctccacgattttcccaaacaaaatgaataatatcttcttttttgtaaagaccatgccaaaaagcaagaagcagatgggtatcagcttctgatattctgattatctcattaccatgagataaggtcatcttcgtactatcaaatacaacacgcttatcaagtaaaaatatgctttcattcatgacaatcctaaaggtaactgcatccatcattcagacgacatattatcatgctcaaaaaagaattcagccccctaattaacctgagtttaacttataactctcacttatagtaaacaataattgacacaagtattacctgcacattacaaatcaaacagttataggtaaatctgaacacttttctttaccttaacgcaaactcaggaaacttctgaaaggccaaaagtaagaaaaaagtaagactaattatactgtttcagaagcacatttcagaaaatttaccttaatctcaccatcgtattatccatcgggaggtttaactgatacggattttacatagcaaaaatgtgcaggttgtattgcaacatagtctatctattcagccgcggagagaattgttatcggattacactcaattaaatgataacactatcagttgtactaatgagatgtatggacgaaagcgcttatcgctctatttcatgatgagagaaataagtctgtttgttttatatcgcattatcaatagtcaggagggtatagctcacatccaaaaatagagttaatgatcgttatttttaccactcctccataagcacgaaacattcgggcgaattgcactcgtcctgaaaaagtaaagattaatacaggaacattattatatgtctatgaaaaaatatttagcaatgatcacaggctcgcttcttgtctccagcagcgcgatggctgtttctgataacaccatcacctttcaaggggaagtctctgatgaaacgtgctctgtcgtgattaatggtaatcaggctaaacccgtcgtgttattgccaacagtaagtactaaagagttatcagaacaagggaaaaccgcggggccaataacgtttgatattgggctgtccgggtgtaccggttctaaggacaaaacaacaaaaatttccaccgtctttgtcggtaatcaggtcaccagtaacggtaacctgggtaatactggcagcgcgaaaaatgttgaagtccaattactcgacacttcaggggagccaatcaatctgaccggcggctttactggcgacggcgacctacagctggaaccaaatgcttctgaagcgagcgcgacttataccgcgcggtattactctaccgggaaagcagaggctgggacagtcgctgccaccctacaatacgccgtttcgtataaataattgtcgctacggtctggcattgaaacgccagaccattttcaatcgccagggagttgttgagatgaaaatggatacccgacattccgcattatattacttaatagtttttctattgctggccctacccgccacagcatcgtgggcgagcgttactattttgggtagccgaataatttacccatcaacagcctcctccgtagatgtgcagttaaaaaataatgatgcaataccttatatcgtacaaacctggtttgatgatggcgatatgaataccagcccggaaaatagcagcgcgatgccgtttattgccacgccgccagtatttcgtattcaacccaaagcaggccaggtggtacgcgtaatttataacaacacaaaaaaattgccgcaggatcgtgaatcagtattctggtttaacgtattacaggtgccaccaacgaatattggcagcgacagcgggaaaaataaaatgttggtgatgctacgctcaagaataaagcttttctatcgtcctgacgggctaggtaaacctgataatctggcgaaaaaactacagattaaaacggtaaataagggttctggaaaaagcggtattgttatcgttaatccgcagccctggtttgcctctttaagtaacctgaatgtaaaagtgaacggcgcttcgtataacctggatgcagacatgattgcccctttttccagtcaaacctggtggctgccgggcaaacggtcactcaaatccttctccggtacagtcaccgttactttggttaacgacctgggcgcaaggataagcgagagctacgatgtcccccaccattaatttgaaccgcaaaagccttgcgctattgatcgccatagtttgctcaggctccgcgcagggtgaagagtattattttgatcctgcgctacttcagggggccacttacggacaaaatattgcccgttttaatgaacagcaaacgccttccggagactatcttgccgacgtttacgttaatggcacgctggtagcctcgagcactaatattcgatttaatgctgtaaaagagggtcaacaggctgaaccctgcctgcccttatcggtgatgaaagcggcacaaataaaatcactccccgagaccgacgctgcgaccgagtgtcgcccgctcagggagtgggtacctcatgccggctggcaatttgatagcgccacgcttcgcctgttgctgacgattccaatgaccgaacttacgcacaaaccgcgcggttatatctccccttcagagtgagatagcggcgcgctggcgctgtttttacgccataacacaaactggacccacaccgaaaataccgatagccattatcgctaccaatacttatggagcggtttaaacatgggcgttaacctcggactttggcaggtccgtcatcaaagtaatctgcgctatgccaatagcaaccagagcggaagcgcctggcgctataatagcgttcgaacctgggtgcaaagacctgtcgcatctattaacagtatcctgtcgctgggcgatagctatacggactccagcttattcggcagtctgtcctttaacggagttaagcttgtcaccgacgagcggatgcgccctcagggcaaacgcggttatgcgccggaagttcggggcgtagcggccagtagcgcgcacgtggtagtaaaacaactggggaaagtgatttatgaaaccaacgttccgccgggcccattttatattgacgatctgtacaacacccgttatcaaggcgatctggaggtagaggttatcgaggccagcggtaaaacctcacgtttcaccgtgccttattcttccgtgccggattcggtacgtcccggtaactggcactattcgctggccttcggcagggttcgtcagtactacgatattgaaaatcgtttctttgagggaacgttccagcacggcgttaataacaccattaccctcaacctcggttcacgaattgcgcagcgttaccaggcatggctggcgggcggcgtctgggccaccggtatgggcgcgttcggccttaacgccacctggtcgaatgcgcgcgcagagcataacgagcgccaacaaggctggcgcgcggaactcagttacagcaaaacgtttaccaccggcactaacctggtactggcggcttatcgttattcaaccaacggctttcgcgatcttcaggacgtgctcggcgtacgccgggaagcaaaaacggggattgattactactccgacacgctgcatcaacgcaatcgcctgtccgcgacggtaagccagccgttaggacggcttggcacgcttaacctcagcgccagcaccgcagactactacaataaccaatcgcgtataacacagctacaaatggggtatagcaaccagtggcggaatataagctacggggtgaatatcgcgcgacagcgcaccacctgggattacgatcgcttttatcacggcgttaacgaaccactggacgtgagtagccgacaaaaatataccgaaaccacaatgtcgtttaatgtctctataccgctggattggggcgaaaacagaacgtctgtcgctatgaattataaccagtccagtcaaagccgttcctcaaccgtatccatgaccggcagtagcggtgaaaacagcgacctgtcatggtcggtttatggcggctacgagcgttatcgcaatagtaatagcgatagcagcgcgccaacgacgtttggcggtaatctacaacaaaacacccagtttggcgcacttcgcgccaactatgaccagggtgataactatcgtcaggaaggactgggcgcgtccggcaccctggtactccaccctggcggtctgacggctggcccctataccagcgatacctttgcgcttattcatgccgatggcgcgcagggcgcgatcgtacaaaatggccagggcgctgtggttgatcgctttggttacgccattctgccttcgttatctccttaccgcatcaataacgttacgctcgacacccgtaagatgcgcagcgatgccgaactgacgggaggaagtcagcagattgtgccctatgccggcgccatcgcgcgtgtcaatttcgccactatcagcggcaaagcggtgctgatctccgtgaagatgccggatggcggcataccgccaatgggcgctgatgttttcaacggtgaaggcacaaacatcggcatggtcggccagagtgggcagatttatgcccgaatcgcccatccgtcgggttctctactggtgcgctggggaacaggggcaaaccagcgttgccgggttgcctaccaactcgatcttcacaccaaagaaccgtttctctatctgaacaaaatctgcgagaaggaatagcacaatgctttttagtttccgaacgctcttgtttatcaccagtctgttcgtcagcgccggaacatggtcgtcatgtataaaagtcaccgataagagcgcgctctctgacgcggcgataaaagcgggctacacggcgcaaaactggatcggcgcacttgacacgaatacgggtaatatcggtttgccaacggtgattagcatcagtaatagtgaaacatttcaaccctccggcacactattggccagtgggatcggtaacttcctgacggccgccaccggaacgccctattccagtaaacaggtactttaccgctgcgattccgccgatgccgggaagctctatgagatgtattcgacaaatggcgatagcgcttttgcgggggcattttttactcccgaagtagaaggcgcctattatgatgtggagcgtaatgtcgctgtccgtatgacaaacctcagtaccggcgaatattacagccgcttctggaaagaacgccaacttaccgcagacagttggtttcaggatgacaaatatatttatattcctgccagcgcgtttagcaacgtgttatatgagatgtttaaaattgactcaagaaaatattttgcctaccagaatccaatggaccgagatacctggacgcagcctcggggttatatcgcgtttaaaggcccaggcttgattaccgagcggatcaaagcgggactggatcatgccagcgattattatggctggcccagctattggcccggggcatggagtacatataatagcgtcacctatgttcgcggcgcgttatgtaaaatcacagattatcctgcgatcgtgaaaattccccctgtcgccgtcggcatattagccgccggaggcaatagtcaggcgcctttccacgtcagcctagaatgtgagtccggtgccgtgtccagtgccctcccgtccaccagcgccgctaatgtcgcaatggggtttgtcgttaatcaacccaccgccgtggcggcggcgcgtcgcctggggctaaccacatctgcaggcggtctgtcgtggctactggacacccattatggcgaacctggcgtagcttccggagtgggtatccgcatctataacgatgccggtacgccgattaacctgttacccgatcggatcaagacaggcactggcaacgcccgaggctggtatggctataaagatttaaccacacgggtatcatccggttcagtagaaacctatagcggtgattttactgcctcgcttgaggcgctcggcggacaaacagtaacggcaggaagcgtgaatgcgcaattacaggcagtggttagttttcagtaaagtcatattaacgctacttgggttgacgggatggtatggcccggcacaagctgccgttaatattgacagaacccgaattatttttgcttcagatgaggtcgctcaatcgttgacattatccaacgataatacaacgccgatgctgttacaggtatggaccgacgccggaaacattgacgcctctccggataacagcaaaacgccgctggtggcgctgccgccggtatttaaaatgcagccaggagaactgagaacgcttcgcctgctcctgagttcccgccagcagctggcaacggaccgggagagtctcttctggctaaacatttatcagataccgccagtcacccaggacattaaaaaccacccgcgaaaactggtgttaccgcttcgtttgaggctaaaaattttaattcgcccgactgggctaaaagcgcccacggaagcggaggagaaaaaattacgctttattgctaaagagaatactatacggatagttaaccccacctcgtggtatatgagtttaacgttaacgatggataacaagaaaagtatcggcgatatcatggttgcgccgaaaacagcacttgatgtgccgctaacacgctcgccaacgccgggagcatcgataaattatgcagtaatcaatgattccgggaactggcgacaatataccgccatactggaaaaatatattagtaagagtaattttattcctgagttttgatgggaaatattcagggatacgatcgtatccctgagacaggccagaattcagcatgtaccattgtcaaaaatagcattaagctgatattttactttttgcacggcatctttgttctgttgagttcccttctcctcaacagacatatcccatacgtttttattatctgattcaattaatgagtagaacgtattattattacgcatcatataaccacgaaaattattttcgatgcccgttgtcacaggcttggcagcccctgaaataacagactccgtctctttattgaaaagctggtattgaatatttgcgcagtttaaatcacagggggaacatttaagatttaaaacaagcagtatcgtgttattttcaaaaacaagggcataatgattgctggcagatgaacataacgggaataacgcgagaagaagaattattatcaatttcatattattatatagactccgtcaaagaaaactttcatttcacttgttcttctgttaactcaccctttcatttcacgcccctgagaatagcgaaaggcataccatgcagaatgaatgctttccgaactgacgtcctcacagacatccataccatgccaaacaagtacgcgagaaagaaaatgagaagattgttatgaaagaaaagtttgtaaccgcttgattgagatggtgccgataataggagtcgaacctacgaccttcgcattacgaatgcgctgctctaccaactgagctatatcggccctgagaagggtgtgttcacgcgggtgaatcacggggtagaaggttaaaactaaccgggcggtgcgtcaatagccttgctactcaaccggctatttttgcaccgctcgtcattaattacgcacgaatcgtaccatcgccaaagcctatccacttataggtggtaagcgcttcaagccccatcggaccgcgggcatgtaatttctgcgtgctgaccgccacttctgcgccaagcccaaactgcccgccatcggtaaaacgggtagaggcgttgacataaaccgcagcggaatctacttcgttcacgaaacgcgcagcattatgcatatcgcacgttaaaatcgcatcggagtgctgagtgccatgttcgcgaatgtgggcgatagcgccatccatattttcgaccaccacaacgttcagatccagagacagaaactcgttatccagctcttccggtttcagcgccaccagtttggcagggccatgcagtgcctgcatgacggtttcatccccatgcaacgttacgccactctccgccatctgcttgctcagcgcaggcaaaaagcgttctgcgatgtcctgatgcaccagcaaggtttccaccgtgttacaggtgctcgggcgctgggttttagcgttgacgataatcttcagcgctggggcgatgtctgcgctgctatcgacaaaaatatggcacacgccaatcccgccggtaatcaccggaatggtggattgctcgcggcagagtttatgcaagcctgcgccgccgcgcgggatcagcatatcgatgtacttatccatacgcagcatttcactgaccagcgaacgatccggattatcaatcgcctgaaccgccgcttccggtaaatcgcaagctttcagcgccttctgaatgacaagaacggttgcggcattcgtgcgatgcgtctctttcccaccgcgtagaatcaccgcattaccggttttcagacacaaagaagccacatcaacggtaacattcggacgcgcctcatagataacgccaaccacgcccaacggcacgcggcggcgctccagacgcaggccgctgtccagcagaccgccgtcgatcacctgcccggccgggtcggcgagattacagacctggcgcacatcgtcagcaatcgctttcagacgcgcaggggtcagcgccaggcggtccagcatcgcttcgctcaggccattggctcgcgcctgctcaacatcttgtacgttcgcgctgaggatactttccatttgcgcttccagttcatcggctattttttccagcacgcgatttttttcgcagctggagagcagcgccagcttatacgacgccgctttagcagcaatgcccatttgttccagcatatgcctgttccttatcgagtaatcatgtcatcacgatgaacagcgaccgggccatattcatagcccagaatcgcatcgatttgttgagagtggtgaccggctatccgccgcagagcatcactgttataacggctgacgccatgagcgatatcacgcccttgcaggttacaaattctgatgacctccccccgcgaaaaattgcccgtcacgcttttgatgccttttggcagaagtgaactgccacgttccagcattgccgcggtcgcgccttcatcaaccgtaatttcgcctgccggcggcgcgccgaagatccaacgtttgcggttctccagcggcgaggcttgcgcatgaaaacgggtgccgacggaaatcccctccatcacatcgccgatcacgcccggtttactgcctgaggcaataatcgtatcaatacccgcgcgacaggccacgtctgccgcctgaagcttagtgctcataccaccggttcccagcccggaaacgctgtctcccgcgatagagcgcagcgcatcgtcaacgccatacacatctttgataagctccgcctgcggattgctacgcggatcggcggtaaataatccttgctgatcggtcagcagcagcagtttatccgcgcctgccaggatcgccgccagcgcggagaggttatcgttgtcgcccactttaatttccgctgtcgcaacggcatcattttcattgataaccggcacaatatggttatccagtaacgcacgcagcgtatcgcgggcgttcagaaagcgctctctgtcttccatatccgcacgcgtcaacagcatctgcccgatatggataccgtaaattgaaaacaactgctcccacagttgaatcagacggctttgccctaccgccgccagaagctgtttagaggcaattgttgccggcagttccgggtagccgagatgttcacgtccggcggcaatcgcgccagaggtaacgataacaatacgatgtcccgcggcgtgtagctgcgcgcactggcggacaagttctacgatatgggcacggttcaggcggcgcgatccgcctgttagcacgctggtgccgagttttacgaccagcgtctggctgtcactcatgattctctgccgttcaaaataagaaataaagaccaaatgaacgttttagcaggactggctccggttgccaacaacctgtacgcgtagcgtgaaattttgttgcgcaggatcagcaagcgtagcggcggaatttgaccattttattaccgcaacaattaaatatatttttttaaaaaaactctcactttgtcataaatctttcattaccgaacgttaaaaaccttcctgttttttaccgggtctcccgacaaatcatagcgcgtaattaaaacaggaatggaaatgaataagagcactctggcaatagtggtgagtatcatcgcatcagcatctgttcacgccgccgaggtttacaataaaaacggtaataagcttgatgtgtatggaaaagttaaagccatgcactatatgagcgattatgacagcaaagatggcgatcaaagctacgttcgttttggttttaaaggcgaaacgcaaattaacgatcaattgaccggctacgggcgctgggaagctgagtttgccggtaataaagccgaaagtgattcgtcccagcaaaaaacccgcctggcctttgctggtctgaaattaaaagatatcggttcttttgactatggacgtaacctgggcgcgctgtacgatgttgaggcctggacggatatgtttcccgaattcggcggcgactcttccgcccagaccgataattttatgactaaacgcgccagcgggctggcgacttaccgcaataccgatttcttcggcatcgttgatggactggatcttaccttacagtatcaggggaaaaacgaagatcgcgatgtgaaaaagcaaaacggcgacggcttcggcacttccgtgagctatgatttcggcggcagtgattttgccgtcagcggcgcttatactctctccgatcgcaccagggagcaaaatctgcagcgccgcggtacgggcgataaagccgaagcctgggctacgggtgttaagtatgacgcgaatgatatttatattgcgactttctattcagaaacccgcaacatgacgccagtttccggcggatttgccaataaaactcaaaacttcgaagcggttatccagtatcagtttgactttggtctgcgtccgtcattaggctatgtgctgtcaaaaggcaaagatattgagggcgtcggcagtgaggatttggtgaattacattgacgttggcgcaatctattatttcaacaaaaatatgtccgcgtttgtagattacaaaatcaatcagcttgatagcgataacacgttaggcattaatgacgatgatattgtggcaatagggttgacctaccagttctgataagtcgcattgtgcctgatggcgctacgccatcaggcatggcagcagggttatgccgacagttttaccggctcgtcgttgaaatcgtcagacggctccagcgccagctccatagaaatcagcaggtcgcgtagcttttcatgaaactcgcgtagcgtgtattccagtcgctccaccacttcggtttcgttaatcggcactacggtccagttgccctctttatcaaacaaaccaaactgataacgataagtgaagcgtttctcttgtgcttccagctccatccaccagccccaaaattcacgcttctctggcgcgggcttcacgttgacgcaaactgccaggcaatcgaaaaaaaaacgattgtcttcgcactgcccttcccggatataggggccaagcgcggtaaatttcttgatcaatctacttttcgggtgtccactcggtaacgtcattgcgatctcctttaatgaagcaactgttttaccaaatcaatagaatttatcaatctattaacacaatctatgattaatccagtcggtaatttcttgcagcgcgtggtcaaaattgcggtacaccgggttaaaagggatctctatcagcttaccgtctgaagatgatgttgtaattaagcgagactcttcttccgggctgaaaggatcgtttttccagaagccggaaagcattggcgtaggacaacgtctgcccagtagcccctgtactttcaacgaatagcggttgagctccacacgcagcgcctcatccgaagcatcatgcatacccagacggctggccagcacatccagatacatctccggcactgtgctctgtcgttgcggatcgctaagtagcgcatggaccaccggccccaggcaagccaccgctttcaaacgcggcgcttccagataggccagacgcaccgcaacgttggcgccaaaacggaaaccaaacgccgcaacacgggtatgatccacccaggggacattaggaagcgcttttaacacatgctggtggagcaagctggaatcctgggttaatttccactttgatgaaaatccaaccgaaggcatatcaagcgttaacatcgcgataccgcgcggcgcgaaatagcgttcatacagggtgtaatagtcgatttgcatggcgtccaggccgccgcacatgagcaccgtcggaaacggaccatcccctttcggcatatgtaaaaacgcggtgacaggcgaaccgccaggaacggcaaattccatttcacgtaacgagcctggcaaccgctgcgcggcctcttcataggcgcgattcgccagcgcctgcgcctgctccgccagctcatcgcccttcaaatgcgggtaggcggcaatgttatagagcgttgaggcatgaagccagtagcgtccgctgcgcatggcgtcctgttcctgacaggctttctgctgccagtccatcgcctgctttgcccactcataaatccagttgccgccgcggtaaccgatgaccgtatcgtataaatcatcatccgttcgctctgcgtcgctcatcacaatgcgcgcctgcacatcaaggatttctcgtgggtcaacgccgcgccaaatccacatcaggcggtttatcatgcgataccaatgcgggacgttcttaccgtccagcgcggattgcatgggcggctgcgacccacgattgaaccgacggacaagggtagacgtttcagtatgtttaaagcggggtttgaacagggtttcgctgaggttagcctgtgtcattcgtgcagcctccttggatactcatagaggcttattgtaaccaataaaacagcgcccggcattgccgggcgctctgaaaagctgctgattaacgacctgaaatcggcggtacaaataccacacccatatcccagggctgctcaatccaggtgttctgaggaatatcaataacataatcatcaaccagcggacggcccgccggtttagcgaaaatcgtgacgaaatgcgctttagggtacatttcgcgaatcgcgacggcggtgccgccggtatcgaccagatcgtcgatgacgataaagccttcgccatcgccttctgcacgtttcagcactttcagttcgcgctggttatcgtgatcgtagctggagatgcatacggtatcgacatgacgaatgcccaattcacgcgccagtagtgcgcccggtacaaggccgccacgacttacagcaataatgcctttccattgttctgaaggcatgaggcggctcgccagtttgcgtgcgtgaatctgcaacatgtcccaggtgacgacgtatttttcgctcatgtgaagtgtcccagcctgtttatctacggcttaaaaagtgttcgagggggaaatagttgcgcgagattatagagacctgacgcgctaaaaaccagtgtttagcggaatccacgcctctttttgtatgctttatactacccgcaggcggagaaagtggtattctcagtcgcatctcgtaagagttattaattccgctaaccctgtggcctgtaagaacgtttttcagaccaccgccaaggagacttatcgtgtctgaactgtctcagttatcaccacaacctttgtgggatatttttgccaaaatctgttctattcctcacccgtcctatcacgaagagcaactcgcggaacatattgtgagttgggccaaagagaaaggcctttacgtggatcgcgaccaggtcggtaatattctgatccgtaagcccgccactgcaggtatggaaaatcgcaagccggtcgttttacaggcgcatctggatatggtgccgcaaaaaaatagcgacaccgttcacgacttcactacagatcccatccggccttatattgatggcgaatgggttaaagcgcgcggtactacgctcggcgccgacaatggtattggaatggcttctgcgttagcggtactggctgacgataatgtcgtccatggcccgctggaagtgctgctgaccatgaccgaagaagcgggcatggatggcgcgttcggcctccagtccggctggttgcaggctgacatcctgatcaacaccgactctgaagaagaaggtgagatctatatgggctgcgcaggcggcatcgattttacctctaatctgccgttgacccgtgaagctgtacccgcaggatttgcatgctttaagctaaccctgaaaggtctgaaaggcggccactccggtggtgaaattcacctcggccttggcaatgccaacaaattgctggcgcgttttctggccgggcacgcagaagaactggatctgcgtctgatcgatttcaacggcggcacgctgcgtaacgcgattccgcgcgaagcgttcgctaccctcgccgttgccacagacaacgtaggcgctctgaaaacattagtgaacgcttaccaggatattctgaaaaacgaactggcggaaaaagagaaaaacctgacgctgcaactcaatgaggttgccagtgataaagccgcattgaccgcgccgtcacgcgatacctttgtgcgcctgctgaacgcaacgccgaacggcgtgatccgcaattcagacgtggcgaaaggcgtagtggaaacatcgctgaacgttggcgtggtcacaatgtctgatgcgaatgtcgaaattcactgcctgattcgctctcttatcgacagcggtaaagattatgtggtgagtatgctggattcgctgggcaagctggctggcgcgaaaaccgaagcaaaaggcagctatccgggctggcagcccgatgcgaactcgccggtcatgcacctggtgcgggaaacctatcagcgtctgttcaacaagacaccgaacatccagattatccacgccggcctggaatgcggtctgtttaagaaaccctatccggatatggacatggtttctattgggcctaccattaccggacctcactctccggatgagcaggtacatatcgaaagcgtgggccactactggactctgctgaccgaattgctgaaagcgattcctgcgaagtaagaaagcgctaaaatgcccgtctcatttctggacgggctatcaatatggaatatcgggtatccattgccagataagctctcctggatgcgctgaatagcgctgcggctacacgcgaatagccagacagccctataacagcgctggtagcaccgaattattgtggcgtaaacgccattcctttaaatatccgtagcggattgccgcgctcaatctgatgatggaacagacgcctttcagacttcaacgccgcacactcattttgccgttgctgttccagccgccaggcaatcagcagccgggccagacgcttattcgcatgttgactgcgctccgactgaaccttcacgctaatcccgctcgccaggtgcgtggcccgcactgccgagtcggttttattaacgtgctgcccacccgggccggaagagcgcagagtctcgaaacgaatctcatcagactgtatgtgctcgtcggcggaaaagcgcccaatgccgacgtaccagttttttcgcccatggtgcgggcgatacgggctggtacaaatccacagtaacgtgccgcaccaacgttcactgaaagccatggctttttcgccgtccagcgagaccagcgcagaacgcagcgtgtctggtaatcgtcccggctctgtttcaagccgtgtcagcgataccttttctctggcggcttctttcgtcagacaatccagcgctttttttaccgccagacaacactcgtccggtccctgcgcagaagaaagttgcagtaagatcatgcgcttttctcccctgaggttttcagcgtcagcaccggacgcaggcaggcaactggcgtaatcagtccggcgtctgccagacaatccacaacgctatcgatggatttatacgcctgcggcgcttcttcataaatgagctggcgatcgcggcaaatcacccggctacccatcccagtacggcagagctgtcgcggggtaaattttgccgataaccggtctttacactcggtacgcatccatttgcgccccgcgccgtgcgccagggagaagaggctctcctcgctgacgacgggtttcaccagccagctataatcgccgcgcgagccggggataatcaccagtccctgcccatctggcgtagcgcctttacggtgcagccaccccgcctcacccgcgacagtacagggttcaacgaagttatgcgccacatccagccgcggttcgccctcagccctgagctgttgcagtatccggcgggcaatcagcgcgcgattactgcgggcaaatgccagcgcatcgtcatgttctgcaaggtagtggcgcgcatcgtcgctatcttccggcaaaccgttatgcgaaaacgcctccacatgacgacgcaggatagcttgccccagaccgcgtgaaccactgtgtaccagcagtaataactgcgctttttgcaaccccgacaaagcgaacgaatcagcatcgacgatgcgatcgacctgctgcagctcggcaaaatgattgccgccgccaatggaacccagcgcagagcgccacgaatgatgctgcattacggcggggacattctcctccagccactgcgcgtccgccacgtcaggcagcgacgccagccgcttctccagtttatcggcgttatatttacgccctaaaatatccgtttgccataacgccatgccgcagccgatatcgttgccgaccagcgccggataaaaacgtccacgcgagaaaaaggctgcgccaataggatagccgcgccccggatgcagatctggcatcccgataacgcgtttcataccggttaacttagccgtcgtatataattgttggatcgcggaatcttcgatccacaggttatccgatgcgatagaaaataccacatctgataaaggacgaatataattgcccatataccattccatatatgaattaaaaaatcaggaaatggcagactaatccagggcaataaaagaaaattaatcctggaaaggtctgcaaagtgcgttcagagaataaagtgtcatgatgaacctcctttgcagttattgagaatgagaaaacgcgggtatagtaatactgaaatttagatggcgcaatcgtaatagtgataaaatcttaatagcctgacttataaccctaacaccaactgtcgttccaactgagggtcgagcagcgttacgtgtagccccaccaaccgtacgccgcgctcgccgcgacgctcgtcccaggttttacgggcggtggtaattaagtcttctttatttaattgcggccagacatgttcctgagtggtttgctgaaaatcattaaattttaatttaacgccctgtcgggcaatcagtaaatcgggctttactatagccagacgacgctccagttccggatataaatgttcaataatggcctcgcagtccgaccattcatgaatatcctccgccagagtacgctcaacgcctaccgatttacgcagcctttcgctgttaacatcacgctcgtcaataccctgactacgctcccataatacccggccaaatttaccaaagcgtttgagaagcatcgccagatcgcactgttgaatatccccgcaggttcttaaccccatattttccagtttggcggcggaaactttccccacgcctggaattttggctaacggcaacgttttaagaaagtcgggtacatcggctggcgtaataacatattgtccgttcggtttattgagatcggaggcgatcttcgccagaaatttcactggcgcaacgccggcggaggcggtgagttgcagttcattgaaaatagtctgacgaatctccctggcgatcagagttgccgaaccataacagtgcgggctgtcagtcacatccagccaggcttcatccagcgagagcggttcaatcagtgaagtgtagcgggaaaagatgtcacgtacatgccgcgaagcctctttataggcgtcaaagcggccaggcagtaaggtgagatgggggcacagctttagcgccatggcagtcggcatcgcgctgcgtacgccaaactggcgcgcaggatagttggcggtactgataacgcctcttcgctcacgactcccgccaatggcaatggggatatcgcgtaacgccggattatcacgcatctctaccgcggcaaaaaaacagtccatatcaacatgtatgattttgcgcatcgctcgcccccacaatactgtttaagtgtacagtatgttttattgcgcgcaaagagacattcgcgttaaaaatgcgacatattcgaaggtatgacgacgaaagcggcgggaaaattgtaaacgtacacacggggacttgcgaaaaactgccgtggtgctaatgtgagcgctccaaatccagattactccgatttggggactcttttgccgttctggcgtgtgtaaccgttttatcaaggaacaagcagtatgcgtaaaatcgcattttttcttgcgatgcttctgatgccgtgcgtctcatttgccggtttgctgagcagcagcagccccgtcacgccggtcagtaaagagtataagcagcagttaatgggctcaccggtctatattcaaatttttaaagaagagcgcacccttgatctctacgtcaaaatgggtgagcaataccagttgcttgatagctacaaaatttgcaactattccggcgggttaggcccgaaacgccgtcagggcgattttaaaagtccggaagggttttacagcgttcagcgtaatcaactcaagccagacagccgtttttataaggccatcaacattggttttcccaatgcctacgatcgcgcgcatggctatgatggtaaatatctgatgattcacggtgcctgtgtttccgtcggctgctatgccatgaccgacagcggcattgatgagattttccagtttgtcaccgccgcgctggtctttggtcagccaagcgtacaggtgagtatttatccgttccggatgaccgacgccaatatgcagcgtcataaatattcatattacaaagatttctgggcgcagctaaaacccggctacgattattttgaacagacgcataagccgccaactgtttctatcgttgatggacgttacgtcgtgagcaaaccgttgagtcacgaagtcgttcagccacagctggcctcaaattatacgctctccgaggcaaaataacgcccattcgcctggcataatcttttgccaggtttcattccccgttagcggctgggtagcaatcacggtaaccacgtcatttggcgtggtctgtgaactgaaatcaatttccatatcctgatccaccagcgtggctacgccaaacggcgcccggcgagtgatccagtgcaaatgggttgagcaaaacgccatcacatatcgcccatctgacagcagcatgttaaaaacgcctttttcacgtaataccgtcgccagtgtcgcaatatatttaaataccgctgtcatgttgcccggcgtgcggggataacgctgcgttaatttatgcaatagccagcaaaacgctttttcgctgtcggtttcccccaccggacgaaaattaccggtttccagcgacttataaccgttgagctgaccgttatgagcataagtccagttgcgtccccataattcccgggtaaaagggtgtgtattttccagcgctacttcaccgcgattagcctgacggatatgagcgataaccgagcaggacttgatcgggtaattctgtaccagtttcgcaatcggcgaatggtagctcggttgcggatctttaaacgtgcgacagccctttccttcgtaaaaggtaattccccagccgtctttatgcggcccggttccgccgccacgctgcaccagtccggtgaagctaaagcagatatccatcggcacattggcgctcatcccaagcagttcgcacatacatcacctaccttaaaacggttaattgcctgataagaccagcaaagcacagctcgtaggccggataagatgcttgcgtcgccatccggcacaatgcccgatggcgcttcgcttatcgggcctactcgttccaggcccgataagaccggcaaaaattatcggcttatttaaccatctctttttcgatcaactgaatcaggatatgaatcactttgatatgaatttcctgaatacgatcggcataaccgaagtgcggtacgcgaatttcaatatccgccgttcccgccattttgccgccgtctttgccggtcaacgtaatcactttcatgcctttttcacgggccgcggcaatcgctttaatcacgttaccagagttacccgacgtcgagatccctaacaggacatcgccttcgcgccctaccgcctcaacgtaacgagagaaaatatagtcatagccaaaatcattactgacgcaggatatatggctaacatcagaaatcgcaattgccgggtagcccggacgattttcacgataacgacctgtcagctcttcagcaaagtgcatcgcatcgcaatgggagccgccgttaccgcaggaaagtaccttaccacccgctttaaaactgtcagccaacaggaccgccgcgcgctgaatggcgtgaatattggcgtcatcttttaaaaaattagccagcgtttccgccgcttcgttcagttcgttacgaataagatcctggtacatgaggatatccttcagcatgaatgtaaatgacagtatgcagtgtaccggatagcagtacaggcgagaagcataagccgaattaacgcctcacgcttttgatttttcgtgcccccaaaaacggcaacaatgtgagctttgttgtaattattttgtaaacacattgctaaaagattttacatccactacaacctaatcatcacaagtggtcagacctcctacaagcaagggagcttttcgttatgatgattttgagtattatcgctacggttgttctgctcggcgcattgttctatcaccgcgtgagtttatttctcagcagcctgattctgctcgcctggaccgccgcacttggcgtcgctggcctgtggtccatctggctgttggttcctctggccattatcctcgtgccgtttaacctcacaccgatgcgaaaatcaatgatttccgcaccggtgttccgcggcttccgtaaggtcatgccgccgatgtcgcgcactgagaaagaagcgattgatgccggtacaacctggtgggaaggcgatctgttccagggcaagcctgactggaaaaaactgcacaactatccgcaaccgcaactcactgccgaagagcaagcgtttctcgacggcccggtagaagaagcgtgccggatggcgaacgatttccagattacccatgaactggcggatctgccgccggaactgtgggcttacctgaaagagcatcgtttttttgcgatgatcattaaaaaagagtacggcgggctggagttctccgcttatgtgcagtcccgtgtactgcaaaaactgtccggcgtctccgggattctggctatcaccgtcggcgttccaaactcactcggccctggcgagctgttgcagcactatggtacggaagagcagaagaatcactatctgccgcgactggcgcgcggccaagaaatcccctgctttgcgctgaccagcccggaagcaggttctgatgcaggcgctattccggataccggcgtggtttgcatgggcgaatggcagggccagcaggtgctgggtatgcgtctgacctggaacaagcgttacattacgctggcgccgatagctaccgtgttgggcttggcgtttaagctttccgatccggatagattgttaggcggagaagaagagctgggtattacctgcgccctgatccccacctcaacgccgggtgtggaaattggtcgtcgtcacttcccgcttaacgttccgttccagaatggcccaacccgcggtaacgatattttcgtgcctattgattatattatcggcggccccaaaatggccggacagggctggcgtatgctggtggaatgtttgtcggtaggacgcggtattaccctgccgtccaactccactggcggggtgaaatccgtcgcgctggcaaccggcgcctatgctcacattcgtcgtcagttcaaaatttctatcggcaagatggaaggtattgaagaaccgctggcgcgtattgcaggtaacgcttatgtgatggatgccgccgcatcgttaatcacctacggcattatgctaggcgaaaaaccggcggtactgtcggctatcgtgaagtaccactgcacccaccgcggccagcagtccattatcgacgcgatggatatcactgggggtaaaggcattatgctgggcgagagcaacttcctggcgcgtgcttaccagggcgcgcctatcgcgatcaccgtggaaggcgcgaatatcctgacccgtagcatgatgatctttggtcagggcgccattcgctgccatccttatgtactggaagagatggccgcagcgcagaataatgatgtgaatgcctttgataaactgttgtttaaacatattggccatgtcggcagcaataccgtccgcagtttctggcttggcctgacccgcggattaacgagccatacgccaaccggcgacgccacgaagcgttattaccagcatctgaaccgactgagcgcaaacctggccctgctgtccgacgtgtcaatggcggtactgggcggcagcctgaaacgccgcgagcgtatctccacgcgtctgggcgatgtgttgagtcagctttatctggcctcagccgtactgaagcgttacgacgacgaaggccgccacgaagccgacctgccgctggtgcactggggcgtacaggatgcgctgtatcgtgctgaacaagcgatggacgatctgctgcagaacttcccgaaccgcgtcgtggccggattgctcaccgcgatgatcttcccgactggccgtcattatctggcgccgtctgataagctggatcacgccgtggcgaagatcctacaggtgccgaacgccacacgttcacgtattgggcgcggtcagtatctgacgcccgccgaacataatccggtcggtttactggaagaagcgctgcgtgatgtcatcgctgccgaccctatccaccagcgcatctgcaaagaactgggtaaaaatctgccgtttactcgtctggatgaactggcgcgcaatgcgctggcgaaagggcttatagataaagatgaagccgccatcctggcgaaagcggaagagagccgcctgcgcagtatcaacgttgatgattttgaacctgaagcgctggcgaccaaaccggtaaagctgccggagaaagtgcgtaaagtcgaagccgcataatcagtctcgtgtctttcctgccccgctttcgcggggctttttcttgccgcttttttattattgctcatgctacagtgtaaagacgctgttcaatgaggagctccgatcgtgtctggtttgaaaattactctgttgcaacaacctttagtctggatggacggcctggcaaacctgcgtcattttgacagacagctagagctcgtatctggccgggatgtgattgttctgcctgaaatgtttaccaccggcttcgcgatggaggccgctaataactcactttcgcaagatagcgtgattacgtggatgcaggccaaagcccgacaaactgacgctctgattgccggcagcgcggcgctacaaactgagcgcggcgccgtaaatcgcttcttactggttgaaccggaaggcaaagttcatctctatgataagcgccatctgtttcgtatggcggatgaacatcaacattatgccgcaggcgataaacgcatcatcgtgcagtggcgcggttggcgcatcctgccgttgatctgttacgatctgcgctttccgatatggtcgcgcaaccgcaatgattacgatctggcgctgtatgtagcgaactggcccgcgccgcgctcgctacactggcaaacattactgacggcgcgcgctattgaaaatcaggcttatgtcgcaggctgcaaccgggttggcaccgatggcaacgggttacattatcgcggcgatagccgaatcattaatccccagggcgacattatcgccaccgccgaaccacaccaggcgacacgtatcgatgcagatctttctctcgtcgccttgcaggactatcgcgaaaaatttccagcctggcgcgatgccgatccattcaccttgtaagcaacctgccgctcaccgcggcgggattgtttcactccgtaactctccgtaaaacaaattcgcgtggcgtaatgtggcaggcaacgtattctgactaagagcctatcccaccaggcgttattggcgcagtcagtttggacacggacagcgcgcaaaaaccggagcgtacacgtagtacgtgaggattttgagcactgcccaggtccaaaatggcaagtaaaatagccctaatgggataggctctaagataattgctcgccattcgtgggtaataaaaacggttaatcactcccttatcaggatatcttcatgaaaaactttgtacgcacaactttactggcagcgactctggcgggcgtttcttttggcgctttcgccaccgctgttcccaatcctcccctgcccgcccaggatcctattgtccagcatctgaagctgacaaacgatcagattacccggatcaaaaaacttcaccaacaactggaaaccgacgtcagtcagatttctatgaagggaattaaagacggtgcgctgatagaggtgattaaatccggtaaatgggatgacgccgccgtaaaacagcagcttgcagccttcagtaacatagaacaacaggctcgctattatcgggttaaatattattttgatttaagcaaagtcttaacaccagaacagcgtcaacaggtacaacaagatctcgcccaagcacttgagtaaatatttttgcccgttattcctggataacgggctttatccaggtcgggtacaaattcatctttttcttacagcatcgcaccatctcacactacccgttacacaacgtagaagtgaaaccgtacgtggggcaatttggcgaggagatggatttccataccgacgattatcgtattgttatttaaaatcttcatctcattttttacccgcttacagaaaacccagcgttacaatagaccgttttttgggcttcgtttatgtaatcgttatatcacaccctataccgtgaaacttgtcttttagcccaatattaaggcaggttctgaaatgaaaaactttttcgcagtctgcatcattccccttgtggtaacctggtccgctactgcatcagcaaaagaagggatctatatcaccgggaaagcggggacatccgtagtcaatgtctatggaatcaactcaaccttcagccaggaggagatagtcaatggtcatgcaacgttacctgaccgtaccaaaggcgtttttggcggcggggttgctatcggttatgacttttatgatccattccagcttccagtacgtttagaactggataccactttcagaggtgagacggatgctaaaggcgggcaggatattattgcatttggtcagccagtacacataaatgtaaaaaatcaggtccgaatgaccacttacatagttaatggttattatgattttcacaatagtacggcatttacaccctatatcagcgcaggcgttggcctcgctcatgtgaagctaagtaataacaccattcctgttggttttggtattaatgaaactctgtctgcttcaaaaaataactttgcctggggcgcaggtatcggtgcaaaatatgctgtaacagataatattatgattgacgccagttataaatacattaatgcaggcaaagtgagcatttcaaaaaatcactatgctggtgatgaacataccgcttatgatgcagacacaaaggctgcctccaatgacttcatgctcggcattacttacgccttttaaacactatcggtaaaatagctggtcctgtgggttcccgaaggcgcaatggaggatatcagtaatgaatactcctgcgccttcagaaaatcgttgaacaggtgcaacctggcgccatttttcagtacactgcaacgtttctggtatgggcttaacttccggctacccaaaaacagtcccgtcctgttgtatgatctctaaatgtgaatggcacgattatgcgagatacttacaagtgtctggtatgaagatatactgcgaacgccgatgtaaacggcgcgcgtaacattttagagcgggacacgccgtgcttgcctgtggaaggagcgtgcagtcaggcagcccgttggagcaggaacccacgcccttcaggacgtggaggatgtcaatgcacaagaattggggaatctttagcagaatttattatctctacagtagcatctctcttgttcccgtcataaataacccaatgcctccagatctgaaaccgccttcagcatgagcactggctgcaaataacaccaaataaaataataatataacaactaccgagacaaaaaacacctctctaaagtatttagaattcatacagtcagctcatttaaatttaacgtcacatgcaaccatgcatgcgtaaaacaagaaccacactcatattaataatgattagtaatgtgagtgtgcgtataacgagatacagatgtatattccttaatgtaacggaacatcatcaatgcaaatagcaaccatcgatatattaaactaaaataatacatctagtgcatatataaaccattcgtatggtggctgtaataaaattgttgataaacggtcatcccctaaacttccagcctccccaccgcacgaacaatgatgttctttatatttaatcgtaataaaaaacaaaacaataattaaacaaaaaataaataagatatttttgattcaaattttcactccttctgttatatacaccaagtttcattttttttatgatcccgaaagaaaaaaccgtcatatgacgatggccattgcattccatacatgtaatcaacttcgttctggtacacggccctctgttctacatcatttatatccccgacaagaatcttttggaacttatgataatgataaacactactaataaaattaggatcacgaggcactacgcaagcctgaaaaaagaatccaaggtttttaatttcactggaataagaatgtttaccacaaaaatcaaaccaaacttccataccataatctctgcgactcctgatgtactcgctcagaaatttgtggttgttattaaagtcaacagaaacagcaaataacccgacgctatttaatttactgatcctttccatatgtatgagcacaaattcccaggggatcctgagtatatatttatttaacccatatttatggttgaataaattaaatgacttttgtaactcttcaaaaaacatcaatgactcaattatgtggttttcgccttttttccagaagggttcaacgaaataaatatcagtaacatcatctgttttaatgcggttttttgttacatgcacggggtgatatttaaccatgtgatattccgctgtgttattctgtgccgcttaatttcaccactgctgattaaaatccttgttcaacagccgcaatctgccgttgttgttccgtaagaaggataataatgtattaaatcagtaagtacacatcacactttcacactggcagttcgtttgtttcctttatttgctcaagaacaaagctcgatgcagatccactaattgaagaattagttaatattattttctcataaaaactatagtaatcgttcatatctgtaaatactgtatgcattaaataattaaatgatccagaaattcgataaaaggcaataacctcaggcattgactttattttctcagaaatactagcgtattgctcctcagatatgttaatcataataaagacattaagtgaaagacctagtttttctttatccaataaagcgaactgaccaatgataacccccctgtctttaagtttttttaaacgtttgaaacatggtgtgggcgtaagtcccactttatatgcaagttgccataaagtttgtgcacaatctttttggatttctttcaataattctttatctttatcatctaaatacacagtcataggaaagcagaacctcacgcattgattttcataagtgaatagattctctttattaaataaaacaagtatataaagagaactctgatttaaaaaaccatataagaaagatatcaataaaataaataattactgtcagggggtttgtgttcccatcagcattgtcactgtcagcgttccctgatactcaccagaacgcttctctctgatgttaaagggttgtgttgtcagggtaaggggcactggcacacaacgtaccgcctgccgttgcccgggaagtaccaccggacgcgttgctgctttatccacgttatccagactgaactccacgccacgggtgacaggaatacttcgtcccccataattcatactgaccgcataatcaatcgtatcagcagaatcgctctttataacctgaaatcccgtacctgacttattgcttccttctatcttcatctgtaatgaacgggctttcacacctccgtcatacagacacatatccagattagccctgcccgacatttgtgaggcattcatccggtgaagattcaggtccacccggggcgttgctgtaccaaattgcggaaagtaaatagccgcattttcagcaaagtggtctgttacattcagcgtgatatctgtagttgatgtgcctaaaggatcgtctccgccccattgtaaataatccaggactaacgttgctttccatgttccgcttgtaggtatcttcgcaagctcttctgaaggtatcctaagtttcagcgacctaccccattgacatgcagcagcgttcatgttgatgacaccagtataacaggcatcacgaacactgccgagcagtatgagcgtgatttcagcatggctgatttgttctctgaaacgcagacgaatttttgaataagctccaaaagcataccaccataccaaatgtgtttcttcacacgccccctcattttcattcctgtttgaacgacatacccatccccccaacacatttgctacactccattcttgggaccagacaggagtgatgaccgctacattgttcttgtcgtaattcaggtcgacggtaatcgcatcggcgacttgtggcagtgtagcgccagccatcagcaggatggcaattatccttgctggataaacatattttcggatgaaattaataattgctgaccaatgggctgtcatactcgtccacttcattttattactcatagttaacgcctttatctctacgtcaggcttcctgaacggaatggcgcagcaaacctgccacgttcagcaaacggatgacccgcggcgatatttgcaacgcctgtggcagggcatccacgtcacttaattcacaccgcacatcacccactacctgcataacatcccgacgtttatgtactgacatcggacaacgcaggatcctgtttttagacagcagccacaggctggattctttatgctcgctctgcaggctaaatcgcccggaaggtcccaacgacaaaaatggatagttcagtggctgtgcgtccagcagcggtctgccatccttgtccagtacgcggccaacgtacagtcggctcatactggcgctgatgttgtgaaccagcagatgcccgggtgtcaggaagtaacacctgcttccccctcccgcttttacgcctgccataccctgtgaactaacccctgcatcctcaatggtcacctccgtggcgttatagccttccatcagcaacagcgactgctgaccaaaaccgagactgaacggctggctgctgccacgaacgctgactactttcccgctactgccctcgtccccctctgactccacgttcaccgccatgccagaggccggttcaccgtcctgaccacctccccagaacagtccattacgggataacgccagagacgagctgtagccagcggtgagtgaactggcgctgcccgcattacgttgatgggagttactgatagtggcgctcagttcacccatacggccgctcatgcgtccgccgagactcccgctccagctgtcgtcgttataaccggagaaacccaccgacagttcacgatacagatcctgctgccaggatctcacatggttcacattccaggacgtctgtgttttttgattccggctactgtgaatatcggtcccggctgaggtatacctattactgccagtcattgtcggtggttgagaggcatatgacacactgacactcataaacaagccatcatcattcattccgtcatttcgggttcgccatactcccccatgggtattaatattcatgccagccatattaaggctgtacgttgcactagcctgagcagattcgcggtgagaggcagggatgtatgcctgtcgccagaacacattttctttgtcactgttatcatcatatccccggtaaaccggccgaccttctgtcctgctggtactgtatcccagtagggcataccagttccccaccgaaaccgacagggaggcgttcatcgaagtctggcaggtcatactggcatgcactgactgtggatgacgaccactacaggcatcactttccgtatggttacgccacagactcgcggaaaatccgtcgttgtatgtcacctgctcagtgttaccgctcgtgctgtctgtcccatgcagtatcccggcagaaaggtccagcgtgccatccagcactgcatgctgtgaattcagtcgggtttcactgtaccaggcctcatgtgccagagagataccttcggtcagactgatatttttccgcagcccagtttggaatccggcagccatgacagtctcaccgtcataatggctggctttatccccggtatcttccagcccgccctgaataaaccactgggtctgtgcactgaagctattgccccccttactgaagggctgggtctccgttcgccgcagaatcccatcctcatacacccgcaacgccagaggatagcttcccggtggaagagaatgagtatccagggtatgcattcccggggtcaggaactgactccccagcaactcgctgccacgataaatatcaatacgggcatttcgggtaacctgaaccataaccggagtggcattatggtccacctcatggttaacataagcttgggtggtcccggttcgtaatccatcaaaccggctcaggggaagcagactgaacccaaaatccccccccgtggcgctggacagattccgctgatccatccgaccagcctggagataatactgattgccgagatcctgacggacaaacagattgtcaaaccaggcctgactgttattgtaatgttctgactgattccagatagccgcccagtcgcctcccagataacgaccgtcaccaagccccagggcaccgctaccattcagtgtcatattacgactgtggagatcatcactcagatacagcgtctggcggtgaataaatgcgctgacaccctccggggtcggagtcagccagcgtttatcacgtcgttcttcatccggcaaccagtcccggttaagaaacaaagataactgagcgttgttctcatcaaaaataaccgcaacatcctctttatctgttgccacgtaaccacactcgctgctgtcttttgcttctgagacaccacagaccagattgctgttacgtagcaacggacggctgagtgcagccagcgctttttgccgttctgcggccggcaacgcggcaagcccactgctttcaagtaccatcaatggggacatgaactgcacggtgtccggtttaaccaccaccggaaataatcccagtgaatgccctggtagcaacacttcaatttgctcagtctgtccttccagcagagattcaaatccaggagggggaataagagttgcctggctggtaaaactgcacaatcccagtaaataatacatccagaaataacgactcacgtaaagagacctgaattgcaatgaataataagatcaataccggatccggttcaggtacgaacggtgcccccccaaaaccggatcagatgaagagctaataaccagttattagccggcagtgacagcctgtgaaatcaccagactgaccaatccgctgtattcaccggcaggcaggttttgtaaggctgctccagccttctgaccaatatccaggttcagcagagctgaagcatcgccagtttttccgtccgggaacagggttttagcttccagtacagaattggtggtggtcagtgaccgtcctcccagagtcacttccatatcaatggttttggtgggatccaggacgttgataagttgtggagcattcaacagttttacattaaccgacttggtctgatcgttgctgtaaaggcgggtctggagtgatttatggaccaggcccttacccggcatgaaatccagcttcatagtcgacgggagggatgaaccatcggcctgcagcagttcaagtgtactgtcaatattggcagtgacggtaatatccttctgaaccgcagaaacagaaaaagaataaacggtggccaatgccacagctgcggcaataaaagatgttttcatgttcataaaaaataaccttgctttgttgtttattacagtgatatatgtacactcggtatacatccgctccccctgagaataaatgtagggtatagcgtacgctccgtgtgtttttactttccggctgctgttaaatcagcagagattaccggtgaatttgcacccgtacgatattccacacgaaatgcattactttttattccggccggaatatcagcactcccgccgggataaatacttttgcctatattctgccagtggcatgtggtgtcgcagttgccagcccgaataagagaaagccgtgtgtttcccgtattcagcaggtggtgaccgtccgttaccagcgcaggcctggggtctgacggagaaacacgcagcaacaccccccagacaagattcacacttacggatgaattttgctttccgcctgcctgtggatcatcttccagttcaggaacagcctcgaagtatacccgccaggcttcctctctttccggtgcctgagtactgataacacgtattgttttttttgttcccggggaaagagcaaatttctccggggagacaacaagtcctgtctctatatcattccctgctggtacctccttctcctgtggcataccggggtgttcaatacgcatgattcttgttcgaatatattgcacatgatctgatttagaatagacgaacagcgaggtggcctcttcgcggctactattaatttctgccgccatgggataaacgagcatattcgccctggcatgaccacatgcaaacatagcgacacagagaaacaccccgggaagagtatctttaaaattcataccagattttaccgtataaaagtcatctaaattttagtattagcatagacagaaagttatcagcataaagaagcaaattacgattcagtgttaatacattttgtgtggagggcatcatacggaataaaatttttcgctcaatacctctgtttttttcaggaaagaaaaaattagtaaataaaagtccacggatttcattcaccaaaagcgaacgacagatctgtaagaatcgctgaacaattaataacgccgcagtaaaaattttggaaattcttcataagaaagttgttactgtgtacctgacttactcagataaatggaactgtatttccccctccttcaaagcaacaaatacgtaacataacaacgtaggagacagagaatctaaagaaagccctccaggagggagatacaattcagactacaaaaccaaataaaccttaaacaaagccacaaatagactgatcatcatgaggttttacaaaaccaggtaaaaaaaagtaagcaaagtaattaatttagaaaactaaagttacagttagatcagatttacttgctcaatatctgttaaaaatatgatatcagcaaacaaaaacttatatacatcatatggttacgcttgatgtttacacctctccagcaaagtgtaatcaatataatacactatttttagattaaatattagctaaatattccacaaacaacaatataaaacagaacaactcaccatgaaaatacaattcaccttttaaaacataatgttataaaaaataccattcaaattgatgccagtcccttacctgtcaatgttgtttacggttcctttcccccttttgtgcgagtaagcaacatgaatatacaagtcttaacgaccaatgcctctgtcagcccaaaataagtcgacattcctgtgcatggcgctgcagcaggaatagaacggcagacatcagcgcggaatggaatcccggctgaaacaggctcgtctgccatgagtcaaaacgctggagcagttcgacttcagcttccagccaggcatcgatcgtaaggtcgtccgggagttggccggtctggcgttcgtggagcgctgcgagaatgtgatcctgctggggcccccggagtggagaaaacccacctggccgctgcccccggtgtgaaagcggcagatgtgggccatcgggtgttgttcatgccgcaggacaggttggtagacgctgatgaaagcgaagctggaaaaccgcctggagcgccagctacaacaactgagctatgcgcgggggctgatcctggacgaaataggttacctgccaatgaccagtgaggaagccagtctgttcttccgactgctgaaccgacggtatgaaaaagcgagcattatcctgacgtcaaacaaaggcttcgcagactggggagagatgttcggtgataacgtgctggcaacagcgatcctggatcggctactgcatcactcaaccacactgaatatcaaaggagaaagttaccaactgaaggaaaaacgcaaagtcggggcgctgaccaaaagcgcaacgccaatcagtgaagatgaaatggcggaaagcggacagcagaagtgatcaaacagcggatattaaaaatagcgaaaaacgaccataaatcctggcgttgacatcctcaagatttaatatcagaagcttccatgccgccgtatccagacttccagttgtccctggtggcttcagaaataccggcctcccggtagacatctttaacagtccgtccggattcaactgatctaatcacagcgatgatctggtgcgcagtaatacgggctttacgcacagcgatctcctgcgttggcagattgattatgccggatgatctctaaatgtgaatggctcgattatgcgggatacttacagtgcaacctagcgccatttttcagtacactgcaacgtttctggcatgggcttaacttccggctgcccaaaaacagccccgtcctgtttccgggtattatcatttccgtcagtcggcatcatgttttgtattgggcatcgtcaaaagacgactggccggccagtcgcatatctcgatgcctcaattcagtcatcatcatgtgggtttaagtcaggaacgtgtcaaaaccattccaaacgagttaatcatcattcagaaaatcaatttgtgggcgattattccatttatcttcaataaaagacagaaagcgttgaaataaaggagaataatactgacgatgacgccatacaagataaatggggagatctggaactctccattcaggaagtataatttcaagttcattattttttaagtatttagtggcaagccaggccggagtcatgaggttgatacccttcccttctaaaaccaaattaagaacactcaaaagattattggaagataaatgaacattaacagcgccactaatagtgtatgattcctcttgacggaaaagagtaagaggtccggaaagaccatggttgtgaagacccacaataatgtgattttccaaatcgccaggatgtgagatcctgccatattttctgatatatttcggacttgcacaaagaaccaactttaaagggcttatctttcgatacacgagatcctcactttcgattatgccacttttaaaaaccagctcatcaaactccagggatttactaaaaaaatcgctacgctctcgtgaatccaggtagatttttgtatccggatagctagctgtaaattcccatatccacttattggcaagaaactcacagacaatagccggagccgaaaattttatactccctctgataattttatccggatttcgcaattcatccagcaaggactgaaaggaagatgttatccttttcatgcttgcataggctgtctgaccagctccagtcagctctaagtgatgtgaatcgcgccgaagtaaagtaacctcaatagaattctcaaggcgactaagcgatttactgacagcagaaatgctaatatctaattcccgcgcagcccgggaaagattccctacttccgccactttaataaatatcatccaatctcgcataccacgattattgatcagttccatcattatcttccgttgataaaagaaattcttatattaaaggagctatcaacgacttactgatgcgtcattgtgtgcctcaatgtccttgatatcatcataataaaaaacctattggctgcaaaatagcatctgaatcgatcatgattttgcatccatctccggttactaattgaacctgtttaccactcagtgtaaataccctatctcagaagcgatcgtcaaggttgtcgccgaaccagatctcaataataaagtggttcattgtcatgcgcccgttctgcaaaggcattctccttttctgtgacgcagtctggagcgcattaattgtatcgttcacctaacaaagtatcccgtggaaacaagcaaaacatcgccagattattcttacttgagtcccccacccggctcgacattatttgtgaaagcggaggaaacagaacagacggtttaaataagacgcttactcaaaacataaacctatgtgcaggctcctctcatttcgtcacgtcgctgatatccagctttactggtgccaggggaagatatctgcgcaaggcaataattccggcgcaacaacaaccactcccgctgggcctctgtacattcaaaatcgcccatgaccaaaagccagcgggtagaagccctgcgccagtgacctgctgcctccagattctgcgcaaccgggtctatcacggcttccggtgttatcttatttctgctcaaaatcagcaccatcatttgggatatagcctacaacccctgcccgccgatgatgggggaggattcggtatgcagcactttcatcctggtctccggctcagtcagctatccgacgtgcccccttatgccgggccagcagcgaagaaaatccgggcgtggtgtgataaaacaggcgacgtttcagccagcccacattctttcgctcctttgtgttgatacgaccaatacgctgtgaaccgatgactggattgttcatacgcctttctgtggtatacaggtatgtgaaccccagctcttcagccacatgaatataatcagaacaataccagccctcaggccagcacagatgctgactgcagtaacccagcatctccctcatccgcttacgactaagaagaatatcgacacgaagcaaatccgacggattacgggacacaggcttctggtcccagcgtcggtgggtgtgcgtgtgcgaatgaaactcaacaaggccactgaggtgcatctcccggacctctgaccagcgcagcatgacctcatcaacccggccttgtttaaccagcatctgacactcatcatgagagtacaccggttcgcctgcaggaatacgaaccggtccgtcactgatcaaactggtcacaagaaagagatgcgcatgcagattaaactcctgcagcaccggaaaaacctgcaaccagttatccagccagccgccatcaaaagtcagcatgacgcttttacgaggcaatcttgcaccatgataaaaagcttccaccgctgcagcagtaacggttttccagccagattcagccagccatttcatctgcgcccggaacgtacggggagataaggttatctgtccgggtttatcactgacatggtgatacattaataccggtaaatgtcgtgcataagacatatgctttattcctttatgtaaaaaataaattatttttacgcctgaggggacaagaaaaagccccctaaacataaaatcttaaatatcacatatgaatacctgacagataaacaaaccttatactaagggcttataaagccccgctcacaaaagagtgaatcaaacaaatccacaaaacagaaaataataaaggcatcagtgtccgttaaattattttacgaaacataatattcctctccctacaaaaaaagatgaatttcagattttaaaatcaatcagcaattgatttttctgcaatgaagattgctaaccatatttgccttgagtaaattttcaatacatcctcgaacctgatatacagtattcgccttattcactgatacaggaagtatgagtggaacagacggctacgtatcctcctgcgccaatgcacaggccttaaaatccagcgtccaggtgtccgcaggcacttcctgattgccatcaacgaccacactgaaactggcgttatctgcagcggttcttaaaatggcgccacgaccactcaccgtatctggttgccacccctcgccctccaggcgaacctgaatgtgatggcgaggatcctgttgcccgctcagcagcaatacggtaggcgtgttacccgccttttgctcatcgctccatacccgaaacccgctgtgactgccgtgataagtcacccagccttgcgcaagcaccatcccatctggcacatgcccggcccgaaagtaagtacctacacgtagcgttgtctgaagtttttctgcggcgttcgctatcggcaccaagctactggcagcgaccagtaagcttacgctatagataaccgttttcactcgctgtattttcatccacattattctctccttcagaatcggctatctgcagagaccgctcatttgatacaagcccgcgattcccttgtgggcaggtaggtggtagttaacccgacattgctgtgctccccatttcaccgtcagttcgcccttatccgccagaccagtgagataaacctggctatcagtatccaccagatcagcgctgccatcctgcccattgactataacctgcgccccgaaaggaatggcgctaccatcttcccgtttcagcgtcatcagtgccctggccccgatgcgagtgtgaaacttcgcttccaccaccgccccttcggttggcaccacgcgcacatcggtttgtgtgacctctgcgtcatccggtagttgcgacggatcgaggctgactgtattctcctgatagacgctcaggttgcccactgtggtgtcgccacgaaaatccgtcttaacgccaggccaggggccaactggcacccccgaggcccctggcgcttcaaccagcgccactgagccttgcaaaggttgccccagcgtcacaccatgatggtggataactatacctcccgcgatattgactcccatctggcgcatcgcccggctgtagctatagtcaccacctaacaggccgtaagccccattccatgccaagtgcaatgcgctgttattaccaccacctggcggggcatcggcacggtaactctgacgcacctcccaatccagttgctgactgaatgcctctccgttgacccccacttgttgcgtctgaccaccgtgtgatggtgaagtcatctgccaactagcacttacattattccccgtccagcggcttaatggcatactgaaccacaggctggttatgttctctttacggtgcccgccattgcgccacagcgttctgttttgattccagttcaatgacagcgagccccctccgatagaggttccccaactcagtccgtagctgtcatcatgaccggggcgattacgccagtcggtacgggaaccgattaaactcagattgcccaaatgcctcccccatgactgactcaacatcagggtggtacgtgagctcggctgcaaattttcccgccacgaccatagacggttgccattatgtcgataactgtcgagcacatcggatagggtgttatagccctgcgaggcatattgccatctcgtcagaaacaaatttgtccccgtcgcagtcagctggttgctgtaacgcagtcgccaggaggctccttgctgtaccgcttccccctgacgctgactgtgtgtgtcgcttccatcgacagataaactcccccaccgcccgagagatcctcccaaaccaagcgatgcagcttgatagtgcgttgcactctgtataccgccatatgcagtgagattccacggcagaccatacatcaacgtagcctgcgcgatctgcgccttatccgttgcagagtctgacgatcggtatcggcccgccaacaggctgtacttcaaatatccctggtgcagtgctatcgccggggtctgatacggcaccacaaacatttgtgtactgccatcggcctcccacacggtgacatgcagatcaccactactgtctgttaccgacagatcccgcagtgcaaacggtccgggcgccacggtggtgttgtaaatggtgtaaccattctgtttgacctccacccgagcctgcgtgcgggcaatcccacgcactaccggagcaaactgccgctcactgtagggcaccatgttgtcatccgatgccaacatcacaccggtaaatggcacactatcaaatatctccccctgcgaagtcttttgccccagagtcagacgactttttagtgagtacagtccacgctcagcataggtatatgctgcctgccacttccccgacagttgactactccgctgccagctggtcgcattgcggacacgccacgcacctatattgattcccggttgcagttgtacccaggaagagttgtcacgccccaccatatccattttgtaatccgtctgcgttgtcctcgcactgtagttcatcagaaacgccggaataccatcatcccaaagatcttctggagcgatccccttaaattccggacgcaacgccaactgcggaatactcagttgcagttgctgattattgatatccagtaccgctttagcctgtggaatggcggtcagatccgcacactcatctggggtctttgctgctttccacaactgagggtaatcttccgtttttacgccgtagcgtgaaagctgactgaccgtcaaacaagaagccagaaaaggcgttccttgcccatccttttctaatttgaacaccacatcacgggtgtcgacacgtttaccattcaccattacgtccactcgataagtccctggctgttgtaccccctggttaaagagcgacatatcaacccctttcgctgcatcgcccaacattgatgcatcgaatgtgtaagtgtgcgcatttgcgcagtgaaccactcccgcgataaacagtagcaaggcaggttgtttgaacttcatattctgccgctaagcccctggatttatttaaggacgtagtggaacggatgactttcaccaccaaagtcagtaataactctccactcgacatcaccatgggcactacctggcatatttagtgttttgtcagcaaaaggggggatatactcaagccctgtaatgggctttccccctactgtgacggaggctaaattcatgtaaaacggggtggggttctccaccttaagtttgttgcccgcctccacccatcttaaatttcctgcaacatcttccggcgtccccttcacggcatccgggcggaaaatcagcttatcacagacgttgatggacaaattgaggtcaagggtcgcgcccttagcctgtgtatccgacggttcattttcgggtggtaccgcctttacacagacccactgtaaagtctcacgatccgttggcatgtcaccaccagtacggacaatacgcagttgactctgctggttcgcttctaaacgaaatagaggcggcatcaccaaaaaaggagcaggcgaacttttgtctgctgctttgactgaagactgaaccaaaatagggtaattctgcgggttgctcaccgagagcgtggctccaactgtaccagcgtgataaatcacccgtgtagcccccagcttcacgctgaatgatttagtgtttaaacttaatttctgctcagcggcatacactggaggagttatagaattagagacgaataaaacagccgccattacaccaaaactaataattttcatattacaagttataaaaaaatgtatgacttgatatttattgcgctttaataaagcgcaataaaagttgtttactattaagcttgatactccgctatgtgtatcgtcactggataagtatcagcctttaccgtttgtgatccagacaatttcacagcgactttgtctgtcatgttatatatccaccacttatgcgaagcaccatccactaatgaaccttttgagccacaggctacccccccaaaggtaattttaatggtattaccacttttaccaattaccgtccacacatcgctgtcgttgcccactgttttcaggtttagaataatctcccgttaccacgtattgtttgctcgaaccgcttgccgaaagtatagcaatagcctcatcacccttatgaggccctgccaccaagccagacactggagtaagctgtgcttgtagttgtccaggattgctgaagtttacatccgccgacacgccagtgcttgtattcggcacgagcgagccagcataacaactagcagccataatgctcaatgcgcttgcgataattaaatcttttatgtttttcatcggaaatccaccttttcaaaatcccccagcacatcaagaatgaataatgtcataccaaaattcaccgtacagaaaagcctgtggctgggaatactttaagacttaataatacttaatagaagttgcttactattaagcttgatatgccgctatgtttacagtcattgggaagacatcagctgggacattctgatctccagctagtttaacaccaagtttgtcgttaatatcatatatgatccactgatgcccattgtaatttacattcccctttggtgaggttgtctcaccatagaagtacactttgattcctttgccagtatttttaccatataaagtccatgtatcgccattcatgacattctttgccttaaaatccgctgcgatcgcgaattgtttagcagcaacagaactaactgcaatagtcgcaatctccgtattagacttaatcaccccagcctttaagcccgccactggagcaaatgttacgctcaactgctggggagaggcaaagccaatatccactgaactttgttgctctgagcccaccacgattgaaccagcataacaactagcagttatcatgctcaacacgcttgcgataattaatttttttatgtttttcattgaaaaaatacctctttaaaactaagttaaaatcgcacgtccagaatgttatgatgtcataacaaattttaccatatgggaaaatccctggctggtaataacaacttgtacttattggtatttgttaccaattcaaacaagtaatgtcataaaaatctatatatcagagcacctcttaatctgaaaaaaattgcgttattgccaatataaccagcattgatgttaacatcgtattgtcagggtggaatagaatgccagtcaaaaagcaattataccttccatttacattcaagtgataacattacaatgaaacccaccacactgggtgtgggaaacttatcttcgaagagaggataattatcaggcatcgttgcaacattgtttatatttaaacatacatctcctaactcgacggtaagattattagttaacttttcctcgcagggaagatctttaatggaaaatcttgttttccgaaacggaaaagcaattataacgctccaacgagagtctcaacactaagagctgactgacacaggccagactgattatacaggcatgaaaaagctctccccttcctttcagttcttgctggattatgcaaacgtcgcaccacctccccgtgaacatggcacattaatttgaagcaactctcatccggtatcgcttttcagtgcagcgaaattcatcgcaggtgcccctgtaaatagacccgttttagttccatgcatttttaagattccggccagataacgttattggcggtattcctccggtatcatattgttccgcgattcatgtggacgttcgcagttatattctgataaccctttatccgtaatttcccgcacctcattcagcgttctgaacagataagaattgagtatttctgtacggtatgtccggttaaaacgctcgatgaaaacgtttttcttcggcttacccggctggataaacgccagctttactacatgtttctttgcccattcagccagtgccagcgagataaattccggtcccttatccatacgcagcatggccggataaccgaggttgctgtaatcctgtcgagtacacggaccactcgcagagctggcagattcagatcgatttcaatcgacaacgcttcacgattacagtcatcaacaacattgaacgtgcgaaaacgacgcccataaaccagctctggttcagcgcttccggcgtgaccagtggcgagggattgcgtaccggcagccgttgtttacccttacggcgaaaattcagcttgagcagacagtaaatacggtggagccttttgtgattccacgcgtatccctgccgccgtatccagacctccagttatccctggtggcttcagaaataccggcctcccggtagacatctttaacagtccgtccggattcgactgatctaatcacaacgatgatctggtgcgcagtaatacgggctttacgcatagcgatctcctgcgttggcagattgattatgtcggatgatctctaaatgtgaatggctcgattatgcgggatacttacatactcacgcgttgagagactttcagttcgtttgtacggtgaatggatgccgcaggcggggtttattaacgggatgcccgtcaaggtgcgggtaatgagggattgcatcgtgatcacgccgcagcatacccgcggactctttgtctgtattgaagggatgggcgtgacttttattaatcaaaagaaggtgaaagcgtggctaaaaacctttccgggggcgctgaacgataccggggatattccggtgattaagcggagcaggctcgaaggcgggatttgacagggggttaaataataaaaaagccgggaagagttaatttctttcccggctttattaacacctaatgtattactggtatctattatacaattctatttcagccagaacatattcactgaaaacatatttagttttctttatctccttcccttctgtatagcaatatacagaagggtcatcatctctttcaataaaaaacaacgcagaatatccttgatgcaataaaaaagaatacattccatctggaatgcttatattattttcttgcatcaactcaactgtatacttatttatatcatttatatctttaaaaagaagatcagtcccttccttaaagtcaccagattcgacacccaaaagagataaaaataatttataagactttggtaattctccatagttttcttccagatacagtatatcctctgtagaacaccccttgacagtcatgttttttgacgttatcgatgcaattaacttcttaatttcaatcaaaaaagctcgctgttccatattaccctccccatgtcacattaacttcaatattaggatacattgctttgaattgagttataacctctgaacatgaggggcatacttttaattccgagtatagatcaatacgaccttttgccgttgttggaaatttattggctatatgttcaaatattttaacttcagaatcgaaagccctgtcatgccccacttcgaaggtagtgaactttcgacttccgtctgctggagtatgtaaaaatggtgaattattcgtattcatgccactaagtgcatcagccgttcctgtttgaccattaatattataattggatgttgcaatatttcgttttccacctacctagccagtgcttctataattcctggccctttctgccggagaacctttaccagcaaattttttacataaacctagcggatctatataacttagcggattaggcgcatattggtagaggtttattccacccgctaaccctatcggatcgcccgatataaacttcccgatatccggatcataaaatctgtacaaattgtaatgcagccccgtttccctgtccagatattgcccctggaaacgcaggttctgctgtacgggccgggtttctttttcatgcgtcaggttcccccatacctgatagcccgcttcccagacaatattgcccccgccgtccgtcatctcctccggcgcgccgtttacgtccgtatggtaatacagcacctcatccgcttcgcccggcgccgccctgtccacccgcgccagcggctcgtggctcccccggtcgctgtagatatacaggctgctgcttcttcccagcctgcactcctgtgccagccgcattccgtcccataaaaacgtcgtccggttatacggctttccttccgcgtccagctcgtgcttctccacccgcctgcccggcgcgtcgtacacgtacccgtaacgccgtacggtgcccccccgggtgaccgccacttccgtcagccggtgctccgcgtcccagcggtagtgctgcgtgccgttgcggccccgcttttccaccacccggccatattcatcgtaacggtaatgcagcccgcgatatgacgttatccggttgaacggcaccacgctgcctgcacccgcctgcgcggtctctccctgccgcctgtccagcaggttcgccgccgcgtcgtactgccagctgtccaggtatgcctcattccggcacgccgtgatgcgccccgtcgtgtcgtaaaaataatccgtcaccccctgccggctgtgccgctttttcagcagctcatcctggccgctgtacgcatattcccggtcaataaacgtctccggcaccacaccgcgcattcctttacaggtcagtttccgcgttaaccggcccgtccggtcgtacatccgccgcatgtccagccgcccctggctccgctgcacctcacggtgcaggtggtcgcgcgtgaactcgctgatgacatcacgccccaggttgatttgctggagatgtccgctcccgtagtacaggtaccgcagcgtccgcccgtccggcatctgcgtttctgtgcggttgccctgaacatcgtaccggtgctgcagcacgccctgcgccgtctcctcgctcagcaggttacccgcactgtcgtagctgaaccggataacttccggctctccgccttccgccgcatcatgccgcctgcggcggatttccagcagacggtccgccgcgtcgtaccggtattccgtgcgcgtctccggcgtgattttcgccgtcagcctccccgccgcatcacgctccagaccgtggcggatttctcccccgcgctccccgccgtatatcactgccgtcaccgcattcagcgcgttatacccgtatgcccggcggctgccgccggggtccgtctgttccgtcacccggtccagaacatcgtaccggaaccggtagctttccccgttctcgttcgtgagcgtggtcagccgcccgtaagcgtcgtactcatacgccgtcctgcgacccgtcgcatccgtctgcctgcgcacccgcccctggccgtcccgctgccagcgtgttatttgccccgccgggctcgtatatttcaccagccgtcccgccgcatccggctggtaacgctccgtacgcccgtccgcgaacatgacctccgtcagatgtccgttgccgtcatagctgtaacgcgtactgttactctccgcgtccgtcaccctttccagccgcgtgcgttcatcataaaaccatgccgtctgcgagccagaacagtccgtgtggcgcataagctgtccgtcttcgttccactgcaggtatttatctccgccccgcgcgtcggttatccgcaccacctggccgtgccggtcatacccgtataccgtgcgctggtgcagcgggtcgctgaccgcctgcaggttgccccgctcatcatactcataacgccacgccacccccgcggcatccacctccgtttccggctggtgccacaccgggtgccactgcgtctgctcaacccggcccagcgggtcatgcgtctccgtcaggtggccgagacggtcatagacataacgccatttgccaccctgcgcgtccgtcatccccagcagtaaccgctcttcatcgctccagcggaaagtggtcatctgcccggcctcgtcccggtacgccgtcaccaggccctgcgcatcccaccagtggcagcgcgtacgccccatgctatccgtcacgcacagcgaacgttctgccagattccagtccagacggtactgctcgccgctgtccgtatgatggcccgtcacccgccacgccgcatcgtccgggccttcaaaccacgcccaggtgtagtaataccgttcgccgcccggctcccggtgcatcgtcatgcagtcgttgtcgtcgtacgcaaactcgcgctgatactgtgccggattttacccactgtgagttctattcacgggttgagggacgttcagttcgtttatgcggtgaatggatgccgcaggccgggtttattaacggagtgcccgttaaaattcgggtgatgaaagactgcatcgtgatcacgctgcaaaatacccgtgaactgttgggctgtattgaagggatgggcgtgacctatatcaaccagcgaaacgttaaagcatggctgaaagattttcccggtgcgctgaatgacaccggggatattccggtgatgagtcgggatcttcagtgtattactaccaattgccggtttgctcactaacaacagaaaaaacaacatcgcggtcatcaaatatcccgtgtcagtctatggattcatttccatttcagtgtcatcaacatgcagcccgacaatcccggcgtcctgtattgcatcgatcagtctgtcagaaaaaaatagccctttcccctgaaaaccgatagtatcaacatcgtaaaatacatctggatatatttttctgggtttaacagaaaaatctgtatttataaatgcgtcgtatgattttaaattaaattcgcttcttttttttgtatcaaaaaatatggatttatttaaatcaattctttcttgtggtatcattggaaaaccaatcaaaaaatattctgtattgaatgtgttgattctggttggtattttattaactggaggcaggttaaagttattcatgatatcaaataattttttagatatcagaaaatcgagtccaagtttgaatggacaaaaatcaatcatatctatttcttttatttttttccttacagggaaaaaacatatttcttgaattttattaacatcaatgcatttaaagtcatcaatcatcactctattataatccttgctatttttcaaaaaaaagccttcgaaatattttttatcttctttacttttaaaggaaagactatcttttatctctaccgagtagactccattaacatttccagtaacttcggtatcataagatactcttatttttttatatttcattattagcaacctcctttaaaatagtcattcagatttttaccagatgcttttgcagcattaattttagacctcaactcatcctgcaaatttcttagctcagttaaacttaattttttattttttataagttcactaattttatcttttacataagcactataggcaggatgattaccatggaaaggtttatccagatcaattaagtttgttacatccattgctttcttcgtgacgttttgcacatatccggtgactttttttaaatccgttttaaaagttttccaaacctcttgcggaattatatggtgtaaatccagtcccagaggatctatccatgtcagtggattagggcagtacgcatacaggtttaacccgccccttaacccaatcggatcctgactgacgaaccgtccacactccggtgcataatatctgaacagattgtaatgcagccccgtctcgtcgtcaaaatactgccccggcagccgcagcggctggtgaaagtacgccccgctgttgctgatgtccgccgcattctctccaaaccccctgatataccccgcccacaccagcgttccgtccgccgccgtcacctcctgcggcgtgcccgtcacgtccgtgtggtaataccacacctgcctgctttctccccgccccgtcacgctcgccaccggcgtgtacggctgttccgcatcgtacacatatgtccgccagccctgctgctgcacgttctcctgcaacagcctgaacccctcccacacaaagtccgtccggctccgcgccgtatggcccgtgtgccgcccgtacgtcgccttgcggattcgcctccccagcgcatcgtagccgtagtgcgtctccgtgttgccgctgatgacccgcgtcagctgcccctgcgcgttccactccagttgctggtcgcgccgcgtggtcagctcgccccactcgttataaccgtaacggtcacgaccacagcccggcagccggttgttcatcaccggaccctgcccttcgttatccagcaggttgcccgccttatcgtaataataacggtcatggtcatacatctgacctgagcgcccggtcaggtaaccgcttctgtcatagctgtacaccacgctgccacgcaggccgtcgtcaatcgtgcccacctcgccgtggttgttccagtaatagtccctcgacgtcacgcagccctgccgcgccgggcgctggccgggaagaacaggggcactgccgggcgccaggctgcgctgccagctcagcagcccgtcgtcgtcatagccgctgtacgtcgcaagctgcccctgcgtgcgcattatctgacggtgcaggctgtcgcgctcatactcgctcaccgtcaggccgtccagcgccgtctgtaacagatgcccgctcccgtaatacagatgcgtcaggtgctgcccgtccggcagcgtgatgtccgtcgggttgcccagcgcgtcgcgctgataacatatgctaccgttccccgcgtgctccgccgtcagccagccgctgcggtcatactcaaaacgcaccgtgtcggcctgcatccggtgctgctgttgccccgcctccgtgggcgtgagcgtcactgccgttatctggtccagccggttgtagctgaacgtccgctggccgtgttcattctccgtccgtaacagacggcccagcgcatcccgctgctgcgtctcccgccgcacgccgccctgcgtacccgtggtctgtatcgccgtcagataaccgctgtcgtccaggataaaagtacggctcagtccgtccgggcgcacctcacgcatcagcctgccgtccgcatcgtgactgaaccggtactgcgccccgttgccgttggtcagcgcggtcacccggccttccggcgtgtactgccagcgcgtctcgcgcttctcctcatccgtgtgcgccgccagcagaccgcgcggcgtataccgccagctctccacgctccccgtgatgcgccggtggctgctcatcagccccagcgcattccaggtatacctgtcctgctgtttccccggtgagttcaccgtctccggcaacccaagtcggttgtagctgatgcgtaccaccttcccttccgcgtccgtcacccgcgtcaggttgccgtcctcatcgtggtcatatcctgtgctacgccctgaacagtcggtgtaccgcgtcatctgcccccggctgtcgaacgccgtcaccaccgtgccgcccgccgcatccgtccggctgcacatctgcccctgttcatcgtaagcgtactgcgtcacccgcccttccgggtccgtctcctgcactggctggccgtgggcgttgtactgcgttttccagacagcgtcatcgtccagcgccgtgcgcgtgatttcgtcgaactcgccgttccactgcgtctgcgtcacccggccttccggatctgtcgtcttcaccacccggttctggatgtcatattcatacgccaccgtgcgaccgccgggcagcccaatgttgacagggaagtggtcttcgttgtacgtgaagcggtacattccaccgcccggcgtccggtgcgcggtgatatacgtctccctgtcgtaccaccactgccatgactccccctgcctgccggtgacggtggtggtgcctgcggcaaaatcatagtcaaagcggtaatgttcaccgtcactggtgtcgtgctccgtcacgcgcggcgcgccgtcgagttcctgccagcggtagcggcaggtgaaccccgccgcattgctgtgcgccgtcatcagcccgttttcataagcaaactgccgcacctgcgttcccgcccggttcaccacgccggtcagttgaccgttatcgtcataccggtactccaccagattgccacaggtgccgccctgcaccagttcaattcgcgacagccgctcccctgccggggtctgtgtgcggtgcagtaacaggtgatgcccgctgctggaggctatccgtaccagtctgcctccttcgtgcccgaagacaatgcgctggcggtgcggcgtctccataaacagcaggtatgccatgccgtcactgtcaaaatcaccaaatacgtaatagctgcgatcggtgtaatgcagcacgtaacgcccgtcatgcaggcggctgaggtataactgttctttcgggccaaatatctggtggccgggcgtcagcatcattttcgggtaacgcagttcccgcccctgtacgccggtcagcgtgatgtgttcatcgtcctcgcgcaggctggtttcccagttcagccgccagccctgtcccaacagtcccacggtttccaggtggctggcgtaaaaacgcgagcaggtgaccggcaggcgaccgggcagggtgaagtccgtttccggcagcaggattttctgcccggtggtcacatccaccggattgctgaacagcccgctgatagcctcactcacggccatcccggtaagctccccgccgataaacttagcggcacatttagtgccaaatttcgtccccagctttgccgcctgccgccacgccccggccagcccgccgagcagactcgccacgacaaacaatacatccaccaccttgcgcagccagtccggaatttcagaactgatttccagtaccgtctgtgtgccgccgccgagaaacacattcggcgaaccgtcttcaaccaccgcatcgcattcggtatggtcatccttacgggcggcaggctggctgttgatgtaaatattgccggaaccctgggcgatgcgtttttctgcgatatggttatcgcatttcaccgtactcagtaccgcgcgcgccgccgggcgactgttggtgctgacattctccgaaccggtgaggatttttcctgccgtgtggtggatggagcgcccgatggcctcgcccagttgcaataccccggaggctatttgatcggccataaaacccagaatcagcccggcaagaaaaccgcagctaaagaaggcaaaggcggcaagcgcgataatggcgatgccgatgatagcgccgataagaaacccggcgagcgcactggtgtggtagatagggtcatccacacgggctgcttcatacatggtcacacctccgtgtgattattcgtttttatccggctgaaagcctgccagccaggtgttccagagtaggtctgctttatcatcaaaaggacggggactggtcagggtgaagactagtaccttgccaggggttgcaataaacccggcctgacgctggtacacttccgttttcccggatttatgggtggcggcaatttgttcccccatcagggcatcattgcccgttcctgcctgtgcaggcgctcgcgacaatacccggtgctgaccgagattttttttcatcagcgcaatctggcggtcaatataggcgggcaggtcttcatcaggttttagcgtatcgcgggaaatattcaggctgggcgatgttcgttcattgccctccaggataaaaatattgacgctgcgatccgtaaatgtttcaggcaggacaaaacacccttcctgtatgcggtatggtcgatccatgagaactccaggtttaattcagatcactcagaggtgggaaggggggcaatatcatcggcggttacggctgtgccgccatccgggttcatatcaatacctttaccaatcagttgcatgacatcgctggtatgcaacatcagttgcttgccacaaaactcaatggagccgtccttatgtaaaacaagcgccgcattgccgcagcgaagtgtgaattgatcgccaacatctaaacgataagtggtgccgatattgatcgtctgcgccagttttacggaaaggccgtcattcttcgttaccgtggtgtttctgtcttcaccaatactgttggtttcatttttaataatggttttagtgcgatccaccataaccgtatgcgtttcattattcttcaccgtggtgttgagatctttttccgcgtggaacttcacttcctccgcgcccgttttgtcgtcaaaacgcagcatgttgccgttcgttggcccgccatacagcgagtggctgaagatcccgctctgcgacgccattcccggcagtccccacggcggcatggtgtcctggttgtaggtacgccccacgatgatcggcagatccggatcgccgtttttgaaatccaccagcacttcctggccgatacgcgggatctggatcatcccgaagcctttgcccgcccatgggtagctgacgcgtatccagcaggagctgttttcatccattttgccgtagcgatcccagccaaactgtacctttacccgcccgtactgatccgtccagatttcctggcccgccgggccggtgacgatggcgctctgcggccctttggtgtggggtttgctcaccgtccgctgcgggcggaacacctcacgggtcgggtgcagttcaaaacgggtggaaaaggtaaagtgctggtcctgcccgctgtgctgcgcgttgtcctgtacaaacagcaaggtctgcatcagcaggtattcctgattgacttcggcggtgggatagttttccagcgtgaaggtataaccggtcatgagtgtgcggatattccctccccccagcacccgactgccggggctgcgctgcgcttccatacgaatgcgcgtcagcatctcgccttcactcttgtcgaagtagtctcccggccactcataatgctcgtaggtggcatgaccggtttcacgcgggtttgccacggtgtttgccagcaatgaacgtggcttcgtaaaatcgaaatcatccagcacccactggccagtccgcagactctcgtttgccgtgatagtgtggataaactccttgtccagcttcagcccttcctggtgccactcgaccagcggcgagtccggacatgctttgtgggcgctgatggcatccgccagcaccagcgtgtggctgtcctcgctgtgctcaaaccaccagtagatgccccactcctgcatcagtcgctgaagaaaatcaaaatcagtttcaccgtactgcacctgccaggtgcgtaccgggtagctttccaccagccgcttttccaccgggtaggggtattccgccagaacctcatccagaatatccaccacggttttattctggaatgctttgtagtcgctggtatgggtcagcagttttacccacggctccatacgcagctcataggtaaccgaacgcccttcatggcccaccacccgcgccgccgtgaccagcccgctgatatgtcgtttaccgccaccatccagttcgatgttgacgcacagatctttgcccaccatcggtttgagcggcaggttggccgccggggagacatagcccagattcagggtgtcgggcgtttttagctgtaccacataactgaacagttcacttaatgtttcgccgccgtccaggctggcgaacagtaatgcgcccggcggtacggcgctgccgctgaccgtcacattatgcgcccccggcccgcctgcaacagcagagacgatggccgataccgcatcctgcgccatacctgcagcggcggcagcctgcgccgctgccaccgcggctttcaccagtcctgatggctccggcaatgcgccaaacagcgatcccgcagcctgttccacggcggcttctgccgcatctgccacgcttccggcgactgaatctgcggtgacaccgccactttctccggttatcggcggcgtggttgtcgtcagccctcccataccggatttattatttgtggatacaaaactcatggtagtgactcctttaataccggattaaaataaatagactcaccgtcaggaaacagtgccccgcactttataatgcaaccagcctgttatatttaaatatttaccagaagaacagggtatattgctgacaagagccatgaaaataaaaacacaaaaattagcacataacataaatactgaattacataaataaggaaatgaatataacaatattatgattttatttttattacgcttaccagattcgcattgcattttataaaaatttgattaataaccagcacaccgccagtcatatactttatcattggtgctcgttacttatctggccaccattgtaatcattgtcaaccacagcacgttcagacacgataatttgatccggttttaacggtattattgttttgttccaccattcgtttgctgaccagaaacatacttaacattaaccgtaaatatcttttcaccattttctttttacgtctcctgtttcagaatacggaaaaacaccggttccacttcaatacaaccatggctgtaacctttggtggaatcatggatataaaaaccaccccgcttgcccccacaggcttttcgggtcttctcatccgctgattccagccggatacggttatatccccagttcgcccagtatatctcacatgttccggcagcctggcctcgcggaatggtactccagccccatgatggtcccagatcacaatccgcagcatttcttatcggtgcctccccctgaaactgaataaacaatttataattcccttccggtatcgccgcatccggcacacactgtttatctggccactgtaaatccggtaaccccgtggtcgccttaaatatcccgataccaggccatgtcagcttttgcccgtcaaaagtcagtcttactgccatcatcttctccctgactattctgtgtattacagcggtggtgtacaacgtatcattagcgccagcttctgatcccgtacagactggttatccaccgataatacaaagctgaaaggataacgtccctgcatcttcgccagtgagatattcccctcctgaagggaatatgcacttccgcgtccgtaaccctcaacatcctgcgccagtaagctggtatagctgattaatgctgagaaacagccacattcaccggtactttttttcagtgtgaccgttgttttcagaatggtaaggttatccatttcctgacgatgaacgggatggatatccacacactccgccagcgggttatcaatgtttacatctgttccgccccaggcaaatacgggcaggaacattcctgcacaggcagacataaacagaacctctacagcgtactttttcacagcatctgacctctatttttttcatccaccagccgcagtgcatccatataccgcccttcactgttctgctgccagaaccagccttgccctggcaggtaacgtatgcccggtagatccaactatcccactattcatctgtacagcccagcccccggcgctgtaccacttcactggcaaatgtcgcgccagtttttttcattatttcttgttgtattttttgcaactgcggaaatataattctctcacatttatttatttcccatatatcaccagtttgagaacttactgaaaacagcccccaataatctattgctccggcagtcggtgtatcatagccaaggctaaaatcataatatcccggatggggaggatttccgtgtttatcctgcaaatcaccgtcaacaaaaacgccatccagcgataaatcatatttttgatatttaagtgcaataatgagtagtttttctgcctgtgctttcgtcattccaccgcgatttatatctgacaaattaaattcagatacaaccgcttgggcataacagaactcagatataaagagaaaaaaaacaagcattattttacggggcatgctattctccgcccgaccataataattattccagcagttatcctggcgtaattatccgtaccaccagtaatatgagatcctgaattaaacccagcagctaccagagcttcagagaagaccagagcatcttttttcccccgaacagcgtcaccatacttgacagcaaaagatcgcgcacaaactgaaaacgaagaaaaaatagccacccaagttttgttactatcctttggatgaacccgacctgactgaaatgatgcaggagcctggagagaaaagtaattattatatcccctggcaatacgacctgtaccatattgactttcggcagcagcaagacccagtatattctctaccggtacgtcaagctcttttgcaattatctcacaaaccttcatgtgctcctggacaaatcttaccgcacccacgttattacacgctttatcataattacccatttcttcattccttagcagatgtttttaaaaccaccatgttcattatttctccgccagtcgcagcgcatccacataccgcccttcactgttctgctgccagaaccagccttgccccggtgttgcctgccccagcgtcttgcccggccagcccggccacggcagataacgcacgcccggcagttctactaccggtgcttcatccggcagcccggtcagttcccagctgcgctgcgatgtacgtcgtaacccgcgcagccactgcgcccaccacggccccggctgccacatcgcccatagctggtccacctgctccgtcagccgcccgcgccgcatcgtgtccggcgtgatatgctgcgccgccagcctcgccagccagtacagccagccctgcgtctcctgcaaactctcgtccagccactcccgaccgcagcgctggtaaatcaccagcggccacgggcgtcccacgctatcccgtgacgccatcagcactccggtcagccagtcagtcgtcccacccatcggcaaaaatcccggcgacatcacaaagctccacggcagcggatggtgttccggcgcgggcatatcatgttcgccacgcggcgacaggtgcatccagccgtcacgctcttcatcggtcgtctggccttccggcaacacgatatgccgcccgctgcccacccatgtctggcggttcagccagtcctgccatattcgtccctcttcagcgcccacccgccagcgcacatagtcgcgctggtccggcaacctgccgaacatcgccggggctgataccaccgctggccggcgcattacaacgccctcgccggacaactgaagttctgcaacagctcccggctgaccgggttaaaatcccgcccggcagtgatttccagcaccacccggcgaccgtcaaaatcatattccaccaattggcgcccccgcaccgccgtttcctgtacctttccggcgtccagcagatgaaacagcgcccacggcccgccggtcagtagcgttgaggtgtcctggcgaatacgcgggctggcggtgatttccgccatcgagccgttgcgcggtcccggccacgtcactttcaggggccggtccggaccatgggcgtagcgcagcacctgaccatcgatatcaatcaccagttccgtgatggccgggtccatatccaccacgctaatctgcatcgaccaggaaaattttttcctgccctcgctgttaaaaaacacgctgcggatctgcttcgcctgctgaaacggcgttaaatccggcccctgcaatgtcatgttgccttcggtcggtttgtagcgccacgggtcgctggcggtgtccgccagcggagccagttgtttgctccagaaagcatccagtacgccgccgctggcgaagatgcggttaaagtcctcggcgctgacctcctgcggactatcggcgaacggatagcgcccgtcgatggcgtcacggcagtcgtcgcccatcatcgcctccatctgggtgttgagcacatcgccggtcccggcgttgattttgcgcgttccctgcttcgtcagatccagcaggatgtttttcagcggcgcaggcagtttcgccgcctccagttgcaacttgtctgcggcagtaatgcgcgctggcaacgtccccgccgccagcgcgctgtcagcaatggccagttgggtgtaatactcgttgagcatggtcagcagcgaagcgatctgcatcgtcccaccgccgctctgtccgccgtccgtccgcccggcaatgacctcgcgcagcgcggcgaaacggtcatccaccagcgttttttccagccgctcttccgggtgaatatcctggaacagttttgccgtctgtaccactttccccgcgttaccggacgcgcgctgcgccagttgtttctgtctggcctgcgggtccggcggcggcaccagcgtggtctgctccaccaccgcttttcccagccgcatcagcggtgagtccggcgacgccagggtgcgcagcacctgtaaatcataggccaggccggaactgccctcttccccggcactgttgatactatggatactgtccagaaaatcctgccagcggcgggcatattccgtcaggtacaaacggcggacttcgcgggcgacagactgctcctgccccggtatctggctgcgcaggctgtcagtcagcttttttggcgtactctcccggcccatcacccagccatcgttcgccgtcgccacaaattccggtaatcgtttgtcgaacagctcccggtaaccttcacgggtaaaaatacccggcacgccccgatccagcggcgcgccgttgctacgcacaaacaccgttcccgcatccgcgccgacggcgcgtaccagcgtgaactcctgcggcgcttcgctctccatcaccgccagcgcccgcgcatagatacgctcggtactggtgtgaccgtcgaggaatgcccgcgcctggcggatcagcgcctcatctttctcatacggtgaatgcaccacccggctgccgtcaaacagcgcttcgatatgcgtcagcacggcggcgcgcccgccaaacccggccacgctgtcgctgttccccagatcgttaatcacccacgactggatctccgccgcgttgtatttatcttcgtgatctttatccagattcagtagcagatagatgcgcagggcatcatacgcagctttactgtcctgacgggcaatggcgtctgccagcacatactccatccgtttcaccagcggcggcagcagcagttgatccagcagacggttgtacagcgacgccacgctgtcggttaccggcggtacgctgtacaggccgtagcgccaggtcagcggcggcgcgtccgggtccagtcggccaggcggacagttcccttgcgctgtccagcagtgccgggacgggagccatcgccggtttaccggtgtaggctttcacatcaccgtccagccgggtcgcgcgggcgctgatttcattcagatagtcgccgttggtctgctggctggtctgcatcccctgccacaacaggaatgccagcaccagtaccagcaggtgcccgccgaggcgcagcaggcggtaacgccaggcccactggaggtttggctccaccaggtgcgcttcacggaaaataaactgtgtcagcaggtcatgcagaaagtagctgcggttgccgtccggcagagcgtgtgggagagaggcggatgattcgccacgggtggtttttatcgcccggacaaagcgctgccagatactcaactggtcggccacggcgtcggcctgcgcctgcgcggcgctggtgaaaaacaccccgcgcagcgtgttattcagttgcgtggcatcgaattttgaatcgaggaagatctgttcaatagcctccagcaacggctcgccgagggcggcgaactcacgcgggaaggtatacagccgctggcggcttttaaggtcgtactcttcctgtaaccgggtatccagtccctgatccagccgcagcgtcaggcgcgccagctcctgcgcgcaggcggcatgcagcgcctgcgggtcgcccgtttttcgcctgcggctgtacggcaacgtaaagccccagatttgtgcgcgaagatggctggtcagcgtacgaaaatactcgctgaaccccggcaacaaatccattttagtgaccaccagatagaccggaaagcgaatccccagggtctcgcgcagttctgccagtcgcgcccgcagagcggcgcaggccgccaggcgttccgccggtggctgtgcggttaaatccgctacgtttagcgtcaggatcacgccgttaagcggcgcgccggggcgatgtttacgcagcagaccgagaaagccctgccactctccggcgttgcgctgcgcggcgctcgcttcgccgccgtcatcgtggcgcgcgtagcgtccagcggtatcaatcaacaccgcttcgttggtaaaccaccagtcgcagtgtagcgtgccgccacccggcactgtcaggatgcgcgaggtctgctccatttgctccgccagcgggaactgcaatccggtgttcagcagggccgtggttttgccgtcgccgggactgccgaccaccatgaaccacggcagctcatacagaaagcgttttccctcgaagattttacgccagccaggcatatccacccgcaactgccgcagctgccggatggcctgcgtgacaatatggttgacggtgcgcaggtcggctttgatctcgcctgccaccggtacctcttccccgcgcggatgcaggaagcgacgcagcagttgttcatccatacgcagcgcacgccacagccggtacaggccgtacagcgcgtacatcagcaggatgaaaccaatcagggtcaggcggacccacagcggcgcaaacggatggacatcgcccagggccagcagcggtgtgacgaagccaatcgccaggcacaggacactgatgccgatgatactcatcgaccagttgaccagccacagtaccagcaacatcagcaacagggcaatggtcaccacccggctgcccacggaggccagcgggcgcagggtatcaaatgacaccagcggcccgacaaaccagaccagcagcgccagaaccagaacgcccacaatcgccagcgcgcgccgggaaaaaagcagactgagaaatttttgcattatatttcgactcgccacccaataatcagtaacagcaaagcgctgagaccagaaaacaatctcccgttaccgtaattaatttaaaaaaaatatagaaagctcttgaaaaataataaatccggaagtcaaaaatacttcacggaccctgaacgtgtgttttcgtctctcaacccttcagaattccggcattattacattccatttcactcaaatcacacgaacggaatttcagaattttagcgtaattcccagaaccaaatttgcttacaggaaaaataacagtgtgaatgacatactgccccggcactggtcggctcaatcagatcgatatgactaccactcccaccattatatccatcaattttccagaagaagaccacaccttttttattacccagttctgtctgaaatttagtcggatcacgccagaccgcaggtttaccgaaaacagttgcctgcgaaagtatatctgccagatttttagcgcctgtttcaatgctccggcccttccacttgccctcttttatcgggagaagacggcctttaaacttcacacctgatttaattaatgccacgctcatacgggccgcacaggtattttcaaactgagcaccaagtttcccctggtcataaccaatgcctgcatagaaatctttcgaatcaacaaaatcaggactttcaaaagatgatgaattatgattagactttagcactgagaataaaggtttcattttttaactcctgtatcacatgaatatttaattaatttatccataataagctcagccgcgcgagaattaagttctttatgtgttttatttttaagaaaacatagacaatttcatttaatgttagcgtcttaaataaatcgtatccacaccatagttttttctccgttgcatcctccacgccaagcagatagatacccgccctgagtttatccagttgattaccagatacccaaaatttaaaaaagtcattacctgaaagattaagcgcatccggcgtcagggataacacaggagatgaccgggaagcaatttttacggagggttcagtcccctgacaggggaaatttttaactaatgcttcctctatcagcaccgaagctcttgcatcaggctttttcacagagtaccgatcaagccaggccagcacagtatggtttattgttatactgtcaacctgaccatatccacaccacgtcttaccttctgtggcatccgctacccccaacacatacatcagtgtattatctttttcctgtaagttatcactggcataaaaccccagaaaatcccgtatactgaggttgacattatcgggggaaattaatcctgcgttaatcagggacccggcaaaaacgccaccgggtaacaggcaacataagatgatcaaaaaaacacggatagatcgttttatgtgatatgtcgctgagatccgataataatcccccgtcacgccacatattgccgaatgatgagacacatcataggtcgatttttttatcattcattcactccactaccagaatttccacccgacggtttttcgcccgcccggctttactgccgttatccgccaccggcaccgtatcgcccttgccgacgatatgtacccgtccggcaggtacgccgccggaggtcagcaacgccgcaacttccgccgcccgtttttccgatagcaccaggttggatgggaattcagccgaatgaatgggctggctgtcagtgtgacccgttacagtgactgcgccgcccacgcgggcgatttcccgcgccgctttgttaatcactggccggattgcgtcactcaccgttttttgtcccggtacaaacatggcgtcgccacggaagaccaccctactgtgctggtcatcttcgtccacggtcagcaggccacgggcgatttcgtttgccagcaggattttcagccgcagcttatgaaccggcacgggcggcggcagttttataccaatcgcatcaatatgctgttgtacggtgacggtctgcacatccatccggtggctgtaaaggccaaacagcgtcagcatcgccaacagggctatcccggcgctcagccagaccggcacccggcgcatccgccgcagtcgtccgcttatcgccccctgaaagtcaggcgagagcgcgggcatgaccggatcgcgacgctgtgaaagctgtgtcagcagttgctgacgaatattgtccagttgcttacgcccgtctggctgcacgctgtagcggccttcaaatcccagccccagcaggtggtagataacctccagtacgttgccatgttcctggaagctggccgccagacgcccgatgatctggaaaagttttatcccgccttcgctttcaccatgaaatgttaccagcaggctttttccggcccagacgccgcgccgcccccaggttgtgttattggcggcttcatcaagcgccgtacacaggcagtaacgtaccgccagtacgtgctcgcgccgcaggttcgcctgatcgcataatgtctggtacagatgcatctcgcgtaccagcagattacggtaaggctctaccagggccgcatccagtttagcgggcatggctgcgagagcgcacaataaaggccgggcagcggcgagcaacgggttagccgccgcgctgatttcagccagccggagtttgctgtccggaccgtcttcaacgatgacattgagttccgtgcgctggctggtgtgtaccggcgtttcatattcactgtccttatgttccggcgtggtggacaaaaaggacatcatgtccgccgctggcggcgtcagggtactgtctgtcatttatcgcgcactccccacagttctgtctccagccccggaaattccccggcggtatgcatggccatcccgccgtaacgggcaatgtgttcccacaatgctccctcgcggcggatgtcgtaatagatgtatccggcctgaaacgggatttggcgcggtggtacaggcagaacctgcaaagccagccccggcagatgcgagcggatcagttccggcaggcgatcggatggcccgattttggtctgggcggcaaaatgttgcagtagcacatcggtcggcattgaagcctttatcgccagtaccagcgtgctgaaatcggcaagatcggaaggggccaccaccgcattcaggataccgtaagtcccctctttcagctcgatgcgctgcgcgccccggatcagtaccgcgttcagcaggaactgcacctcatcaaccagcgatttcaacccggcatagggcgtcaggtgtttgtactctttgtattcagcgggccgtcgcgtttgtggacgcacataggtggagagttccccggccagttcggacaggtagcgatacaacacttccggggccagcggggttttcgccaggtgagtcagcagcggctcaaagcgattgagaatttgcagcagcaggtaatcggagacctccgctgcttcatggccgtggttgtcgctgccggtcagccgttccgccagcgaatcggcccgcatccggatgagatcgttgatccacgacagccaggtacacatcagtgaactggcctgataattaatgatgggcgggatcaggtcgtggtcgatatctatccgcccgtcagggttcaacccggtgatgcgggtcaacggcaggccaatccaggcgcccgtcaccgccttttccggcagcagccgcaggcgcagatgactgagctgtaataactgcgcgccacgtcccagcgagttggcgtcgcggatgtcgtgttcatgtaccgagaaacgcgccagtgattccgggttattgtcaaacgtggtttcttcgctgttcggcgcgcgtaccggtaccgccagacaaatctgctggttcaggtgctccggcaggatggtcagcggcggcggcagcggggtgtggttcggtgcgttaaacggcgtgccgtcaggaaaaatccctgatgcctctttcagtatcagtttaccgatgttcagcgcttcgccatcaatattgtagtggctgaatccccagaaaaagggagtcagcggcaggctgcggtaatgcatgacgtgttccagataacgctcttgctgctgaaacatctgcggcagtaaaaattgtccttcactccagactacgcggtcattccagctcataattcatttatcccgttccgtaattacaatggcgctttgttccagttccgcctccaactgcacttttcctttccccggtatgaagctgctgtaccaggctttttccggggcttccgggattttgtaggttacccgccagaccgatttggccaggttacggtatccggccagtacgccgattgccgtggtctgcgcattcagcgggcgacgcagttttttctcttcgccgggacgcaaaataaagctgtcgcgacgcactaaatcgtcggtaaggacggatttgtcgttgtcatggagcgaccagtaatcagctgtcgtgaaagcggcgtcattttttagttcataaacacgtatctcaatgggcgcggccttcttctgattgtcaggattcaccttatcggaggctttcacgctcaggtcgagtcgctgtgattcgaggtcaggtaacgcatcgctactgccgcatccggaaagcaggagcagtgcaaaaggcatagctaccgcacataaccaccgagtggggttacgccattcattcactgtaaattcctttaaaatcaaaacaataaatccggccagatataaatctggccggaaaaacagccgttaaatttctttgttcgccttgaagtcgtaacctgcggtgatagtgccgccgctgccgccctgctggttctgcaccacgtattcctgtttcacagtgctgaaagaaagctcgaccgtttcacgggaggcgatttcaccatcgtggctgccgctcggggaaaccacggcgacaatcaggtcggtgaaggtatacttgaggtactccagcggattgccgccagccttacgcataaccagaatggcctgcggaatgtgcttgccggaggcgcagtatttgaacaggttcgggctggcgcgatcgatatagtgatcaaaatccagattagtgacggagaccttaccggagccgaggccgctaccggcgtgcatggtggattcctgatgaatattccagcgccagctcagtacttcaatttcatttttgtgtttgtcatccattgactcgccatcaatgccgtcaatttttaaaaaaatgtcataagccatttttatatccttattaagttttacttaaaataaacctggtttatcctgataatttgcgcagaaataaaccgttgccgtacagaatccccttccccgtaatttcaggagaacagaaggctgtctttttccgctgccaatattattgaagtatttacttcacgaataaatcttaaacattaacaggcatcttttatgcgtattctggcatcagagtattcatataaagattatatattttatttacaaatcaatttcgccggtaagacatccgggctccagcatgtcgcaaccgttccctgaacttttctggcaagcagaacagcccactgtccataactacacgagaaccagatcccccggcgattatcctctgggtctatctcccacaggtgcccctttttcccatcaacgactgcatcttcacctttcagatctgcctgctctttgggatcgccagacgaaagaaaaccaccatcattcaacatacgcgctgcacgggatgagacattccatccttccgctgaggaaattattggagcctgagaaaaatgaataaccgcagggcagacaatctcatcggcatgaacaactattaccggaagtaaccacagaatgcccccgacaatacaggtgctattcaacgataaaataggcttctgcattattactcatccttatataagtcccgtcactacgaacacttccattatgcaactttcttatataacgtttggacacacggggttttgcgatatcatctttccattgatccatcacccatatcccgccagtatcttgccccaaaaaaaatgcagcatggttgccactattgtggttcggatatcgcccattcacaaaagtagcgataactgtcccgacttcaatgtttttgtttccaaatactgcggccccttgctgccatgtactcgcttgtcctactcgtatatagtgttgaataagttcaacacactgatggtggtttcctaccttttctgtatcctgtaaagcctttgcattagcataaacatatggcatatattctcttaatatcctctgatattatttatacattcacaaaataaatgcatcaggcattgccctgcttcactgacggcagttttgtcaccaggcgcagcgatcctgtcagcccttcaagctggaaatgcggacgcaggaagaatttcgcgtcgtaataacctggattgccttccacctcttccaccactacctccgcggcagccagcggacgacgggctttggtttcttgcgaggagttcaccggatcggcgtcgacataattcataatccattcatttagccagcgctgcatatcctcgcgctctttaaaggaaccgattttgtcgcggacgatacatttgaggaagtgcgcgaagcgcgagcaggcgaacaggtacggcagacgggcggacaggttagcgttagccgtcgcgtccggatcgtagtattcctgtggtttttgcagcgattgtgcgccgataaaggcggcatagtctgagtttttacggtggatcaacgggataaaaccgtttttcgccagttcagcctcgcggcggtcagagatggcgatttcggtcgggcatttcatgtccacgccgccatcgtcagtcgggaaggtatggcagggaagattttccaccgcaccgcctgattccacaccgcgaatcaacgtacaccagccgtagtgtttgaaggaacggttgatgtttacgcccatcgcgtaggccgcgttgctccagacgtatttggtatggtcagaaccatccgcatcttcttcaaaatcaaactcgtccaccgggttggtttttgcgccatacggcaggcgggcaagaaaacgcggcatcgtcaggccaatataacgggagtcttcgctagcccgcagcgagttccacggcgcatattccaggttctgggtgacgattttggtcaggtcgcggggattcgccagctcctgccaggagtccatttgcagtaccgagggggaagccccggcaataaacggcgcatgggccgacgcggcgactttggcgatagagccaagcagatccacatcgggcggtgtatggtcgaagtagtaatccgcaatgatacagccataaggttcgccgcctaactggccgtattcggcttcatacagtttcttgaacatcgggctttgatcccaggcggtgcccttgtaacgcttcatgttgcgccgcaattcatcttttgacagattcatgaagcgaattttcagcttttcgtcggtctcggtgttgtaaaccagatgctccataccgcgccacgaggattccagcttctgccagtcgggatgttgcaggatcagtttgatctgttcggtcagtttaaagtcgatctgcgcaataatagcgctgatgcttttataggcgtcatcgctgacggtgatcgtgttcgccagcgcctgttgcgccagcgtctacaccgcggcttccacagcttttgccgcctgggtagtcttgggtcggaaggcctgattcagcaacgcatcaaattcaccggatgcggagacggtatcctgagcaaccgcgtcggttgcctgcatattactgtttgccatgaaaattccttaaaaattcgacattattccgctgattcattatccgctgacacaccttgctgggtagcggccgatttcggcgcattcgccagcgttttcagcagagtcgggtcctgcaacagtttattgaccagattttccgccccggccttgccatccatgtaggtctggaggttcgccagttgagtgcgggcttccagtaactggttcagggcgtccaccttgcgggcaatctgtgccggcgaaaagtcgtccatattttccagggtgatatcgaccatcaactgaccttcacccgtcagcgtattcggcacagcgaacgccacgcgcggcgcaatggctttcatgcgctcattgaagttatcaatatcaatatcgaggaatttgcgatccgtcaccggcggcagttcttcacgcggtttcccggccagatcggccagcaccgccatcacgaacggcagctcgatttttttctcggaaccgtaaatctctacgtcatattcaatctgcacgcgcggcgcgcggttgcgcgcgatgaatttctgcgcgctattgttgatagccataatccttcatttcctttttagtcaactggttgccgcaaggggagcggtataccggtacagtttttaaaaatcatactcagagagtttttttataatctctttgttttctttgtacttttcccgtaacccaggaagtgcttttttcgccggagggcaccaggtattaatgcccttttttatgtcttttttatcctcttccggtaaagaactgtcccattcgccggccagatgctggcacatctctgcattgctcagaaaatgctgcacatcctgtggtaaaggcggttcgccatgaacactgaaagcgaacatcattagcaaaggagtcaataacgccgggtcacgtaatgtcatatttaatgcccatcaattgaccagtggggtttatctgtatttccgccgacaaacttagtcacgccataaacccactgcgcaccacttaactcttttggcatattccctcctgcgaggttgtctcaaaaacaatctgctcatcaccattaacgccgatatcaatctgcctgatagcggctttttccgtcatggcctgcaaccagtagcgcgacagttgtggcaggatgtgctgttcgatgtagccaatcagcaaccgcgcgcccgtttcatgcattggacagcacgccacaatatgtgcgaccagttcctcactatacgtcagcgtcaccccgtgctgttcacccatccgcgccaccagccggtcaagatgcagacgggcaatcacgccacgcgacgtttcatccagcggcaggtaagggatcaccgtcacgcggcccagaaatgccgccgggaaatgcttgcgcaattccggcattagcgcctctttaagccccgtagcatcgggcattaaggccggatcttcacacatctggctgatgaggtcggaacctacattggtggtgagtagtagcgtggtgtttttgaaatcgacatgtgttccctcaccgtcctccatcccgcccttgtcaaacacctgatagaagagttcatggacgtcatggtgcgctttttcgatctcgtcgagcagcactacgctccaggggtgacgacgcaccgcttccgtcagcacaccaccctcgccatagcccacatagccgggcggcgcgcctttcagtgtggaaacggtgtgagcctcctggaactcgctcatattgatggttaccaggttctgctcaccgccgtagatagcctccgccagcgccagcgcggtttcggttttaccgacaccggacggcccggccagcataaacacgcccaccggtttgcgtggatcgcccagtcccgccctggcggtctgaatacgttcaccaatctgcgccagcgcgccgtcttgcccggtaacgcgttgcgccagtcgggcaggcagttccagcacctggctggcctcatctttcaccatgcgcccggcaggaataccggtccagtcggcgacaatcgccgcgacaatcgccgcgctgacttccgggaacaccaccggcgcgtcgccctgccactcccttagcgctgtttcggcctgttgcagcgtggttttgtcatcagcatcagactctgcgacacgcagttcctgcaacgtatgtaccagttccagctcccgctgccagcgggattcggatgcagtcagttcatcgttgagcgagaaaattcgcgccgtcagcgcatcgcaccgctcatctgactgaatccccattttttcctgcttctgcaacagcgaccgttccatttccgccgcttttagctgctgacgcaggaactgtacgctggcaggcggcgtgtgcagcgtcagcgccacgcggaccgcggcggtatccagtaggctgatggccttatccggcaactgccgggcgggaatgtagcggtgagaaagctgtaccgccgcacgtaccgcctcatccagaatcagtacgttatggtgtttttccagcgtatccaccagaccacgcaccatttccattgcggggatctcttccggctcggcaatctgcaacacctgaaaacgacgggtcagcgccggatctttctcaatatggcgcttgtattcgctccaggtggtggcgccgatagtccgcagggtgccgcacgccagcgccggtttcagcaggttagcggcatcgcccgtgccggatgcgccgcccgcgcccaccagagtgtgaacttcatcgacaaacagaataaccggctgcggcgagcgcccggcctcttccagtaaccctttcagacgcgattcaaactcgcctttcatgctggctccggccaacagagcgccaacgtccagcgccagcagccgtacttcccgcagcgcgggcggcacttccccctgcgcaatcgcgagggcaaaaccttcgacgaccgccgtctttccgacgcccgcctcaccagtcagtaggggattattctggcgacggcgcagcagaatatccgtcatggtgcggatttcatgctcacgccccgtcaccgggtcgattttgccgtcgcgcgcctgtgccgtcatgtcctgacagtattttgccagcgcggatttaccgtcctgcacgccgttgggaatcgcctggctgctttcaccgggaatggctgatgccagaccggagccgtcgtaagggcgctcctgcgcttccggcgatgtttcgatcaacgagggcagtatttccgtcagttcatcaaccggaagcgtggccagcggcgcgcagatactgctcagtacccgacgcagttctggcgtggtcaacaaggccagcagcaaccagccgctgcgaattttgttatcgccgtaacggacgctcgccagcatccaggccttttcaacgctgagatcgatatggtgagaaaaatcactaatggcgctggccccggcgggcagcatatccagttgccggagtaacgctttctccacatcagaaagagggatctggtaatgccgaagaacgtggagaatatcgttatcgggctgctgtgttaactggtgcagccagtgagtcagctcaccccagggattagagcgtagtttgcaaaatgccgttgccgattccagcgaccggaatagtgggccggccagttttccatataacgcactgcgtgaaacaggagtttccatttgttatgccttgtgacataaaaattcataaaaataatgcatcaatgcacatgaatatataaacaattctttattaaaatgttcgacaaaatatcgaaacaaaacaatgatacagatcagggactaattagcaaccaagccgttaatattaaataatcaatgaacaacaagataaaaatcgcaattacagaattaaaagaaataatatttcaaaaaagacatctatgcatacaacaatgcattcacgacgaaaataataaaaagggtgtcatcaataatgactccctatgaatttagttaaaattatttatgaattaaaactccctaaacgtttcctccagaaaaataaatacatttaagggacataatgaaacaagacatgtgggaattacggaaaatacagtcgcagggtataacggataacgcacagtatcccgcagggacatacatcgtatttactgccgccgccccctacattccgctttttgagcaacatgggaaagacgatatcgcgctcagtcttgttcgccacgaagaggcgtggtggattgttaatcactcggatgaactgtgctgtgccgtcaatgagcaggtgatggaacctcatcaccgtatgcggctgaatgatggagatacgattgaatggggtctgtcatcctggtgccttgcccgcaccaatgatgagtcccgtcccgatgtttcgtttcctcagttggttcagtcatctgaatccgttgctgagtacctggatctggactggtttaaacaacaacagctcaatccgcagaacccgttcgatattattcccgtccgggaaaccgcgccctcttacaccggccatgaagcggatagcacgctacaccagctttaccaggaatatcagcaggccttgcggccctccgggcaggaaaagcccctccgtcctaaaccgtttccccgaaatgaagacgctgtcacccaggatttgacgtcgttatacgataaaaagggcgataccgacacgttacaggatatggtggcaggcgcgcccggtattgatgccattctggatacgctggacacgaccggtgagggtgaaatgcactggctggcgatggaatcaatgcccgatatcctacaactgctctcgccggaaatgggggggaaaaccgcacatagcgagatactgcccgatctgacccgccgcgagcatcgtattattggcatcgatagccactaccgaatcactccgacacagaaaaatggaaataccgcccatgaaaaaaactgacacgcttcctgctaccctgtccgcgctgctacaggaatactctattgcggaggggattcagatggcggagcagcaggttcgggaaaatccggcgaaggcgctctgccgccacagcctgtttcagttgctgtgtgtggccggagactgggcgcgggcgctacaccagcttcagctctgtgccaggatggaggcaaattatacccaggaggcccggctgtaccgggagctggtttgctgcgaaatgttccgccacaccgtttttcagggtgaacaacgacccggttttcttctgccgcagcccgtttgggtggagtcactgctggcggcactcgcctgtcatgacgataccggtgaggttgataaacaccgtaataccgcactggaagccataacagacacgggcgggcagtggaacggcggcgcatttgactgggcgagcgacagcgattcccgccttggcccggtacttgagctggtcaccggcggcgtgtatatctggctaccgttttcgcaaatacgctcgctggaatcgccgcaaccgacgcgcctgaccgatctgctgtggaaacccgttaatatcaccctggtgaatggcgatacgcacggtgcctggctctttacccgttacagcggttcggaaagtgcatctgacgccctgcgtctgtgccgggaaaccgcctggcaggacggccccggcgaaaccaccgtgcgagcgctggggcagaaagtgtggctgaccagccacggcgatatcagcctgctggacatgacccattgtacctttcatgctcaggaaaacgatggcgcatgagcacgtctcgttttacacccgctaaccacctgctgcctacgctgtttgatcggctgtgtgacaatgctccgtatcagaaaattgaccgggatatcagcgtcacgccggtacaactgaaggagatcattcgtcgggatctctcctttttgctcaataccattagccacgagggtgacatcgacgcccggcgctatccgcaggcggcggcgtcagtgctcaactatggcctgccgccgctggcgggcagctttatgtatgagcacaagtgggacgatatcagcgaggcgatccggcgcgccattatccgtttcgaaccccggctgaacgccgccacactcagggtcacgcccttgctcgatgaagcccggcagggtagctataacacgctacagtttgaaattcgcggacaaattctgacgcagccgtatcccacggagtttctggtacgcagcgcgctggatatggagctgagccgcattacgttcttttaatacagggcattattcatggatccacggctactggagtattacaaccgcgaactgagttacctgcgggagaccggtgctgagttcgccaccctccatcccaaaattgccgcccgactggggatgcagggaaccgatattgccgacccgtatgtggaacgcatgatcgaggcgttcagctttctgagcgcccgcactcagctaaaaattgacgccgaatttccccgcttcacacagcggttactggaagtcgtcaaccccaattacgtcacccccacgccatcgatggcagtggtaaagctgtatcccgatacgcaggaaggcgacctggcgaaaggggtcaccgtgccgcgcgataccgcgttcgtttcccccatcccggaaggcgaaaataccgcctgccagtttcgcagcagccaggacgtcacgctgtggccgctgtccatcgaggaggtacgcctgaccgccgcgccgccggatatgcccgccctgcaccgctatctgccgcctaatattcatgtcgccggggcattgcgcatcaccctgcgaaccttcggggaactggctttcagcgagctggccggtccggcacggctgctcttttacctctgcggcgaagaacgcattgcgtcacacctgtttgagctgctacataccagcgccgtcgccacactggccggagaacccggtcactttgacggcgaactgaatgtgaatcttcaacacccggtggcgcacgaagggctggagccagggcaggggctgctgccgctcgcctggaacgtgtttcatgggcataatctgctgcatgaatttttcgcctgtccggaacggttttacttcttcaccccgaccggattgtctgccggtctacaaaaggtgcagggcaatgtggcggaaattgttatactgcttaaccgcctgccgccggactggctgattcatcagacggacgccgcacagttcagcctgttctgtacgccggtgatcaacctgtttccccgcaccaccacccggattgaagtcactcacagcgtgacggaacagcatctggtggtggatcgtacccgtccgctggattacgaggtgttttctgtccaggaagtcgaaggcctggaagcggaaaccacacggaagatgatttttcgtccgctgtatcacacccgtaataatgacgaaggcaaccacgggcgttatttttcactgcgtcgtgagccgcgccgatcgtcagaaagcgcccgccgctatggcacccgaaccccctataccggctcggaagtcttcctctcgctggttgatcagcatgaagcgccctacccggaaaatctgcgccatatcaccgtcacggcaatggtgactaaccgcgatctgccctgccttattccacgtaatggccgggatgatctgaccgtagatgcggcgattccggtggcgggcgtgggtcttatcagaccgccgcgcccgccgcagccgccgctggctgaacgcgaaatggcctggcggctgatccggcagttgtcgtttaattatctgccgctggccgatctggatcaccgcaccggcggccaggcgctgcgcgatctgctgaacctgtttatcccggctcacgacagcccgcagtcgcgccaggtgcgcagcctgattggctgcaaaaccaccccggtgacccgccgcctacccggctccggcctgttggtctatggccggggcgtcagttgcgaactgaccgtggacgaagaaggattttccggtatcagtccttacctgttcggtctggtgctggaacactatattgcccgccatgtttccattaataccttctcgcagatgacactgcactcgatgcaacgcgggcatgtcatgacctggccggtcagaaccgggcaacgggggagcgtatgaccggcgctctcgaccaggcgcagaaagccccctggcgttacggattcctgaacctgatgcgacgcgtggatgcccagctctgtgatactccggcaggcagtatctggcagcctcggatggaaaaattccgtctgggacagacgccgacgatgacctttgcaccacgggaaatcgcccaggtcagctggcaggatggacgcctgcacctgagcctgtacagcctcggactatgggggccaaacggcccgttgccgctgcactataccgagctggcgctaaatcgctcagagagtcgtcacgatccgacgctggttcatttttccaatatttttcactaccgctggctgacgcagttctggcaggcatggcgcagcggccagtccgctggtggcgggctggacaaaccggaacacgaccgttttgcgttttatatcgccagtatcagcgggcaggatctacgggaaagcgccgaaagcccgctgtcagatcatgttcgcctggcggcctccgcccatctggtacgcgagtcgcgcaatcctgacgggctggccgccacgctggcgcactatttcagcgtaccttttgcggtgaaagagtttgccctgcactggataacggtggcgaacgatgaaatcacccgtctgggcacgcccgcgcagtcttcggtgctgggcaacggggcgcttatcggccaggccgtaccggatatgcagtacaaattccggctaattatcggcccgctcacgctggaggattacctgcgttttctgcccggcggcaacaatctgcccgtgctgacagaactggtgcgtacgttcatcggttttgaatattgctgggaaattgagctgcagttgaagccccatgccgcaccgcctgcggtgatcggcggcgcgcagcggcttggctggacggcctgggcaggtaaagccatgcatgaccgtccggtgaccggcatgatttttgaacctgaacacggcttaacccactgagagtaatgatatggacatgtccctgactaaaccggtaagcgcggaacaaccctgcggccccgatccggagtacgatccggaatacctgctgctgttcagccgcgccgccccccaggcggaggcgcaatatggtgattttgtcagtacgccggaagccgtgaactggccggaaattgagcgtgatgcgcgccgtctgctcacgcgcagtaaggatatccgggtgttgatcctgctgctgcgcagtcgcatccagcaggctggcgcacagggactggcggaaatgctcacacaactggcagaactgagcgtaatctggtctgatgcactccatccacagctgcttaccggcgaaggcgcatccgcagaatctattgaagatgcggcgctggcgcgcagtaatgccctggcggcgcgctggatcacgaaggcgtgatggcagacattcgcggtatcacgctgtcaaacagtgccgccctgcacctgcaggtacgggacgtggagcgcgcgttatccgcccctcgcccggctgatgcgctggcccccgaatccgtccgccagcaactggcagacctcgaagcccgtggggcattaccgctagcggcgtttcgcgaagcgcaggaaagcgcagaacgcctgcaagtgtgggcgcgtgagacattaggcgatctggctccagatttttcacgcctgcggcagttgttagcgctgctgcctgacgtggtacagacaaccacgccggaaatccctccgtcgccagcgccagcgccagctcccgcaggcacggttatggataatgccattcctgcacgggcagaggatgtgccgcctgtcaacgcgccacccggtatatctatcccacacaatgctgaaccggggccaattcgcgatcgtaatgatgcgctggaacgcctgcggtgcattcgtcgctggtttgagagcagtgaacccagcagcccgaccatcccactattacgtcaggctgaaagactggtgggaaaacggttctcggaggtgatcaatgagatcccggtggagttgctggagaagtgggatgccctggagtgatgatgcgcatgtctggcggttctccgtgattatctgagtgacatcaacattactcggtctgcttctgcgctgaacatgtcccgatcccggttaagcaccgccatgaggccgcgccttaaatgtcagtgggacaaaataaccatgacagtgaaagaagtggcggtaatatcctgttcgtcatccaggcgtaggcccatttgcgccagattccacgatagacggtggaacttcttgaagacgaaaaaaaaccgtatcccttttacagtgatacggtttttttacttcacaggatgtataaaaacaccctgagatttgtatctggcggaacggacgggactcgaacccgcgaccccctgcgtgacaggcaggtattctaaccaactgaactaccgctccgtgatgttcccgctgggaacgaggcgaatattacggtttgcggtgtcgcccgtcaacgctttttctcaccttttgaatcagttgctgcaaaaatcgcccgaaggatgatttttatagcctaaaaaggaataaattatgcccgccaaaggcaacttccgccctttttctgcaccagatcaagccgcgattcatgcgcagccagctcttcctcagaggcaaaaacgacccgtaaccggctggcctggcgaacgattcgctgaatggtcgcttcaccttgctgccgttgcgtctctccttccatcgcaaacgtcatggacgtttgtccgcccgtcatcgccagatacacttcggcaaggatctgggcatcgagcaatgcgccgtgcaaagtacgtttgctattatctatctcataacgcgaacacagcgcatcaaggctgttacgcttgccggggaacattttccgcgccaacgccaggctatcggtaactttgcagaaagtattggttttaggaatatcgcgtttaagcagaccaaactcataatccataaagccgatatcgaacgatgcgttatggatgaccagctccgcgccgcggatataatcgagaaactcatcgaccacatcagcaaaaaccggcttatccagcagaaactcatcggcaataccgtgtacgccaaacgcttccggatccaccagccgatccggcttcaggtaaacatgaaaattgttgccggtcagacgacggtttatcacctcaaccgcaccgatctcaataatcttgtgaccttcatagtgcgcgcctatctggttcataccggtggtttcggtatcgaggacaatctgtcgtgtaattgcagtgctcatatcggtcatttatgtcagacttgcgttttgttatcgatttcaattacaggaagtctaccagagatgcttaaacaggtagaaattttcaccgatggctcttgcctggggaatccagggcctggtggttatggcgctatcttacgctatcgcggtcatgaaaaaacgtttagtgaaggttacacgctgaccaccaataaccgtatggaactgatggcggcgatcgtcgcgcttgaagcgttaaaagaacattgcgaagtgacattgagcaccgacagccaatatgtgcggcaaggaattacccaatggattcataactggaagaaacgcggctggaaaacagcggaaaagaaacctgtaaaaaatgtcgatctctggaaacgtctcgatgctgcgttaggccagcatcagatcaaatgggtatgggtcaaaggccatgcaggccatcccgaaaacgagcgttgtgatgaactggcgcgcgccgcggcaatgaatcccacgcaggaagatagtggctaccaggcagaagcttagccatccggtttgcgatattgccgggtggcgccaacggtctggcggataggggttttacttttattatgtcgcagcggattaagcgtaagcggaatggtccgcttacgggccacaataagctgtaaacagcccagcgccgggatatgcgtatttaaaagccgccctccctgctttttccagggtaagacatgaaaacggctataatgtagcacttcgaaattgagtaaagacagccagtccagttgccgcataagggtaaacatccgactattatagggcggtgttttacgtaaaacgagtaccagtttacgtaaccccatcaaactcagcgggttaaatccactgatgaccagccaaccgtcatcaatcaatacgcggtcggcttcccgcaataaacggtgcgggtcggtacaccacggcaaagtatgcgccagcagacaaacatcgacggatttatccgcaaaaggaagatgtagcggatcggccagaacctgcatcggcgacccctgcgatgaaacattcacttgatgggagaccgcgcacgcttcggaattgatttctgcgcttaaattaccgattttaagcaaatggaaaccatacatttttgcaaaccacggatttagctgctgttccagcgcctcacggtagtaattgccccagggcaactcaccccaacatccgggcgcaacgacagtttgagagagccttgccggtttcatcgcaaccttccgctaattatttgagaggtaatatatgaatcttaacagtattcccgcgtttcaggacaattacatctgggtgctgaccaatgatgaaggccgctgtgtgattgttgatcccggcgaagcggcccccgtcttaaaggccattgctgcacataagtggatgccggaggcgatttttctgacgcatcaccattacgaccatgttggcggagtcaaagagctgttgcaacacttcccgcaaatgacggtttatggaccggcggaaacgcaagacaagggagcaacccatcttgttggcgatggcgatactattcgcgttttaggcgagaaatttactctttttgccacgccgggccacacgttaggacacgtctgttactttagccatccttacttgttctgcggcgacacgctgttctctggcggctgtggtagattgtttgaaggcacgccatcacagatgtatcagtcacttatgaaaattaactctctgcctgacgacacactcatttgcagcgctcacgaatacactttagctaacattaagttcgcattgagcatacttccgcacgattcgttcataaatgaatattatcgtaaagttaaagagttacgtgtaaaaaaacaaatgacactacccgttattcttaaaaatgagcgtaagattaatctttttttaagaactgaagatattgatttaattaatgaaataaacaaagaaacaatattgcaacaaccagaagcgcgttttgcatggttaaggtcaaagaaagacacgttctgataattcttacttgtcattcgctaacttcgccgttatgatcggtcgtcttttaagcaactattgacacacacatgaaggcaaaagcgatattactcgcctctgtcctgcttgtggggtgccagacatctcagaacactggcaacgtccaacagcacgcacagagcctttctgcagctggtcaaggggaagcaggaaagtttacgagtcaggcacgatggatggacgacggaacgtctatcgcgccagatcaggacttgtgggctttcattggcgacgagctaaagatgggaattccggaaaacagccggattcgcgaacagaaacagaagtatttacgcaataagagctatctccacgatgtaactttacgggcagagccgtatatgtactggatagcggggcaggttaagaaacgtaacatgcctatggagctggtactactacccatagtggagagcgcttttgatcctcacgcaacgtctggcgccaatgccgcaggcatctggcagatcataccgagcacagggcgcaattatggtttaaagcagacccgtaattatgacgcgcgtcgcgatgttgtagcctctacgaccgccgcgttagacatgatgcagcgtctgaacaaaatgtttgacggcgactggctgttaactgttgcagcgtataacagcggcgaaggccgtgttatgcgggcaattaaagcaaacaaagcgcgtggaaaaccgacggatttctggtcgctttctttgcccagagaaacgaaactctacgtacctaagatgctggcattgagtgaaattctcaaaaacagcaaacgctacggcgtacgtctgccaacaacagatgaaagccgagcgctggcacgagttcgtttaaacagtccagttgaaatggcccaggttgcggatatggcgggcatgtctatcagcaagctgaagacgtttaatgccggtgtaaaagggtctaccttaggcgtaagcggtccgcaatatgttatggtgcccaaaaagcatgccgagcagttgcgtgagtcgctggcttccggtgagattgacgccgttcagtcccaactgatcgccgacaatacgccgttgaatagccgtagctataaggtgcgctctggcgatacgctttccggtattgcttcgcggcttggcgtaagcacgaaggacttgcagcagtggaacaacctgcgtggttcccgcctgaaaatcgggcaaagcctgaccgtgggcgctggcagcagcgcgcaacgactggcaaacaatagcgatagcattacctatcgtgtccgtaaaggcgattcgctttccagtatcgccagacgtcacggggtgaatatcaaagatgtgatgcgctggaaccatgatacggataatctacaaccgggcgatcagcttacgttgtttgtgaaggacaatagcacgccagactcctgatattgtccgacgaaaaagccaaaaggcgccgcttcccccggcgccttttaaattgttataccgctttatgcgcttccagcatgatagtatcgctgctaaacgagccgtcatcctgcaactcaaaataacgcttcacctctaccggggcgctcgcctgatataatcgaatcgcctcaaccaacggcgctggcgtacgcatccgcgttacccatgagcgaaactccagcgataaacgatcggttatcacggtattcgttaccagcatcgcgttattgaccatcgccagccattcaccactggaatagttacggacatgcgacgtgtcgcgtaacgcctccaccgtttgcagccagatatcgcgtacaggatgtccaggcgacatgacatccatgataatcagcacgccgccgggttttaatacacgataaacctcacgcaatgcctgaccaacgtcgtgccagtgatgcgcggaatagcggctaatcaccacctcaaacgatgcatcttcaaagggcagtttttcggcatagccttgccggagagtaatattacttaaatgtctttcttccgccgctccagcgacaacctcaagcatgctggcggataaatcgtatgccacgaccgaattgacatgttgcgcagcgacaaaactcgcgtgtccagccccacatcccatatccagtacgctcgcgtgggaaaaatcagacaacctttgcgccagccgcgctaagtcacgacccgctgcgtgaacggcgctatgtaaataggcgttcgcctgtgaaccaaactgcttttcaacattgtcatggtgggaatgcgttgtcatggtagtgcccttctgttatgagaaaaatagagggcagcacccgcagaggcctgccccacggcagacctgactcacctttattgctcaggtttgccgggactgaattcaacgagtagcggattgtgatcggaagcgcgcgtcaccagtacggaggcttcattcacgtttaaaccacgataaaaaacaaaatccagcggtcgtccaaacgcacgacggcgttgatcgtcagtgaaacgcacctggcgcagcgacatctcacgtgcaaagcggtacaacgcattcatacgtgggcggctccaggcattaaaatcacccgccataatgacagggccgctatggtgcgcaatctggtcgccgatcggaagtaactgcttactgtatacgtccacgcccagactaaaatttaccgcatgaacatttactaccattaataaacgggtatccggcaagggatataccgtcaccagggctgatttcgccaaacgtaaaattggttctctttcccgtaaagggcagcagtaaacaggatgggcggcagaaagcgtcataacgccagacgggtgctgaggtaatacaaaagcgggaacctgatcggcggcaagatagttagcggtggcaaactgtaccagttcaggcgtcgtctgggcctcctgcaacaggaccagatgcgcatctttgccgtagttcttcagcaccgataaccattcggctcgctgctgcttgaatatattccacacgaggatacggatccgctcttcactgcttagcggttccccggcgggcaatgcctggccaatgctcgcaaacgaccctagcggcaaaatccgctcggcgggctgtccggcaacatagcgcatcgcataggtgttttttcgcacttttgactttcaaacctctgtaacgtcaaccagtcctcaaccggactggttcttctgttatagggattttagcactcactttcaacgaacaattgcagtttgttttgtaagtaggcgcttacatcaataatttactccagagcaatgcgcacaggtttatcaagacgtccgctgacgcccatcagcagaaaagccaccagaacaatgagggcgccaatccacggcgtctgcgccaaaccgtaatgcgccaccgtttgtccgccaatcacggaacccagcgcaataccaatgttaaacgccgcaatgttcagacctgacgccacatcaacggcattaggcgtgaattgttccgctttctgtaccacgtagacctgcaaccccggtacgttaccgaaggcaaagatccccatcaccagaatggtagccagcgcggcatactgcgtggaggccgtcacctggaagaccatcagcagaacaaacagcgcggcgaaaatgaatttcagagccggcacggcaccatgcttatccgccagtttaccgccccagatattgccgatagccactgatacgccataacccagtaggatccagcttactgctgccggagagaatcccgccagatcctgcatcatcggcgccaggaaggtgaatgccgtgaataccccgccgtagcccagcgccgtaacggcgtaaatcagcagcagacgaggatgagtcagtactttcacctggtcacgaatgctggcggccgcccgaccaggaatattggcagggatcagcagttgactgctcatcagcgcaatcacgcctaacagtgataccgcaaggaaggtctcacgccagccaaaatgctgaccgataaatgtccccagcggaacacctgttaccagcgctactgttaaaccaccaaacataatagcgatagcagaagccgctttctctttcggcaccagacttgtcgcgatggtagagccaatcgagaagaacacgccgtgcgccaggcccgtcagcagacgggcggcgattaatgtcatatagcccggagcctgccacgccagcaaattccccgccgtaaacaagaccatcagcgcgaccagtaactgtttacgcggcaggcgtccggtcagagcggttagcaccggcgcgccaatagccacacccagtgcatagattaaaaccagcattccggcagaaggtaacgagacagccagttgttgtgcaatggtcggcaccaggccgacaatcacgaactcagtcgtgccaatagcgaaggcacttattgtcagtgcaaataaagcgagaggcatacataactccataacagcagtaatcagatgacacgcagtatgccaggatgttttaatgacaaaaatagccaaaatataaatttaattttgctgcaggagcagaaatgaaagccacctccgaagaacttgcaatttttgtcgctgtcgtggaaagcggcagcttcagccgggcggcagagcagctcggacaggccaattccgctgtcagtcgggcagttaaaaagctggagatgaagctcggcgtcagtctgcttaatcgaacgacccgacagttgagcctgactgaagaaggagagcgatacttcaggcgtgtgcagcagatactgcaagaaatggctgccgcagaaacggaaatcatggagtcgcgtaataccccacgcggcttactgcgtatcgatgcggcaacgccggtaatgctgcatttcctgatgccgctgattaaaccttttcgtgaacggtatccggaaataaccttgtctcttgtctcctcagaaacgttcatcaatcttattgaacgaaaagtggatgttgcgatacgcgcaggcacgttgacagattcaagtctgcgcgcacgtccgttatttaccagctatcgtaaggttatcgcctcaccggattatattgcccgttttggcaagcctgagagcgttgaagagttaaaacagcatctgtgcctggggttttctgaacctatctcgctcaatacctggccgatagcctgtagtgacggacagctccatgagatcgaatgtgggatttcgtccaacagcggggaaacgttaaaacaactttgcctgaacggtaacggcattgcatgtctttcagattatatgattgataaagagatcgcgcggggagaactggtggaactgctggccgataaacgtctgccggtagaaatgcctttcagcgccgtttactacagcgatcgcgccgtcagcacacgtattcgggcatttatcgactttttgagcgaatatataagaacagcccccgcaggagctgtgaaagaggggtaaaggtacaaaggatcgggtaattaatcccaggcaggagccagtccttccgggctaaccagacgatcgttgcagtccagcgccgcgatcgcatttttatcttcggcatccagatgcagatcctgcgccagcaggttgcttgccaggttttcacgcctggtggatgaagggatcaccgagtaaccttcgcccattgcccatgccagaataacctgcaccggggtcgcattatgtttaaccgcaatgcgcgcaatcacttcatctttcagcgctttaccgtatgccagcgtcatgtaagaggtgatatggataccgtgcgctttcgcccagtcaaccaccttacgattctgcagatacggagatagctcaatctggttggtggcgatatggtctgcgcccaccgcggcaatagccttttccatcaacggaatagtgaagtttgagatgccaatttcgcgagtcagcccttgttttttagcttccagcaatgcctgcataaattcttcgacagacacggcatcacccggagatggccagtggatcagcgtcagatcgacataatcggtacgcagttttttcaggctctctttcaggcttgggattagcttgtctttgctaaggttttcaatccagatcttggtggtgatgtacagctcattacgcggtacgccgctctcagcaatcgcctgtccaacagccgcttcattatcatagatttgcgcagtgtcgacagcacggtagcccagttcaagcgccgttttcacagaagcgataaccacgtcgtctttcaggcgaaaagtacctaaaccgaatgcagggatagtcatagaattcctctttttaatcactatgttcgttaactgaggggattatgaccttcagcgctttgtagaaaaagagcgagaaatgcagaggatttttgcgaattgagcaataattaaatcgcaggcaaagaaaaagccctgagctaatgctcagggctcttaataagtggcggaacggacgggactcgaacccgcgaccccctgcgtgacaggcaggtattctaaccaactgaactaccgctccaccgaattcttttacaaccactgatttttacatcaatttactgcttaatttgatgcctggcagttccctactctcgcatggggagaccccacactaccatcggcgctacggcgtttcacttctgagttcggcatggggtcaggtgggaccaccgcgctagtgccgccaggcaaattctgttgccggaaacgaatcttttatctttcgttcccgaaaatccggaatcagtgctgaaaatcgtctctcatccgccaaaacatcttcggcgttgtaaggttaagcctcacggttcattagtaccggttagctcaacgcatcgctgcgcttacacacccggcctatcaacgtcgtcgtcttcaacgttccttcaggagacctaaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggatcacgggtccacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaggagcttcgcttgcgctgaccccatcaattaaccttccggcaccgggcaggcgtcacaccgtatacgtccactttcgtgtttgcacagtgctgtgtttttaataaacagttgcagccagctggtatcttcggctgacttcagctccgtgagtaaatcacttcacctacgtgtcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcgtcacgcctcagtgttaaagtgaaccggatttacctggaacacatacctacacgcttaaaccgggacaaccgtcgcccggccaacatagccttctccgtccccccttcgcagtaacaccaagtacgggaatattaacccgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacacacggtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacattagcacccgccgtgtgtctcccgtgataacattctccggtattcgcagtttgcatcgggttggtaagccgggatggccccctagccgaaacagtgctctacccccggagatgaattcacgaggcgctacctaaatagctttcggggagaaccagctatctcccggtttgattggcctttcacccccagccacaggtcatccgctaatttttcaacattagtcggttcggtcctccagttagtgttacccaaccttcaacctgcccatggctagatcaccgggtttcgggtctataccctgcaacttaacgcccgattaagactcggtttccctccggctcccctatacagttaaccttgctacagaatataagtcgctgacccattatacaaaaggtacgcagtcaccccaccactaagccccctctgcttcttttgaggttgaacgtcgctttcgctccgttaaccgtctcctcagcaaaggatgcgtatgtggagttcaccactggcttagtggtggggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatatgcgcttttgtgtacggggctgtcaccctgtatcgcgcgcctttccagacgcttccactaacacacatgctgattcaggctctgggctcctccccgttcgctcgccgctactgggggaatctcggttgatttcttttcctcggggtacttagatgtttcagttcccccggttcgcctcattaacctatggattcagttaatgatagtgtgacgaatcacactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttctttcgattcatcatcgtgttgcgaaaatttgagagactcacgaacaactttcgttgttctgtgtttcaattttcagcttgatccagatttttaaagagcaaaacttcgcagtgaaccctttcaggtacactctgaagtattttttcgtaaacactcacgagatggtggagctatgcgggatcgaaccgcagacctcctgcgtgcaaagcaggcgctctcccagctgagctatagccccatcgtgtagtcagaacctctttaccgataatttttcctgagacaaggcgtggaataacgaagcatacatcagtatgtgagttatttcacaacgcagtattcagggaaaatctggtaggcctgagtggacttgaaccaccgacctcacccttatcaggggtgcgctctaaccacctgagctacaagcctgtagaggttttactgctcgtttttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcacgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacagttcccgaaggcaccaatccatctctggaaagttctgtggatgtcaagaccaggtaaggttcttcgcgttgcatcgaattaaaccacatgctccaccgcttgtgcgggcccccgtcaattcatttgagttttaaccttgcggccgtactccccaggcggtctacttaacgcgttagctccggaagccacgcctcaagggcacaacctccaagtagacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcgaatgcagttcccaggttgagcccggggatttcacatccgacttgacagaccgcctgcgtgcgctttacgcccagtaattccgattaacgcttgcaccctccgtattaccgcggctgctggcacggagttagccggtgcttcttctgcgggtaacgtcaattgctgcggttattaaccacaacaccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttacctcaccaacaagctaatcccatctgggcacatctgatggcaagaggcccgaaggtccccctctttggtcttgcgacgttatgcggtattagccaccgtttccagtagttatccccctccatcaggcagtttcccagacattactcacccgtccgccactcgtcagcaaagcagccaagctgcttcctgttaccgttcgacttgcatgtgttaggcctgccgccagcgttcaatctgagccatgatcaaactcttcaatttaaaagtttgatgctcaaagaattaaacttcgtaataaattacgtgttcactcctgagacttggtattcatttttcgtcttgcgacgtcaagaatccgtatcttcgagtgcccacacagattgtctgataaattgttaaagagcaggtgcgacgcggctttcagctcaccgtcgcgaggtggcgtatattacgctttcccgcttcagagtcaagcgtttattttcgcttttctcacagacttcttaacgaagtcttcctgacccggcggcctgtatgccgttgttccgtgtcagtggtggcgcattatagggagttattagagcctgacaagacctaaatgcaaaaaaaagctcaaccgttcacttttcaaacaacatttgaatcaaaagcctatttttgcctggtttttaaacaaaaacgagcccgttagggcccgttttattcaaatttgtgacttactgcactgccacaatacgatcatcattggcttcaaggcgaatcactttgccaggaaccagttcaccagacaggatttgctgcgccagtgggttttcgatctgctgttgaatagcacgttttaacggacgcgccccgtagaccggatcgtaaccgttggcgctcaacagtttcagcgcctcgtcggagatatggatttcataaccacgttcttccagacgtttgtacagacgctgcagctggatctgagcaatagaagcgatgtgttgctcacctaacggatggaataccacaacttcatcaatacggttgataaattccggacggaagttttggctaaccacacccagcaccatctctttcattcgaccgtaatccagttcgccaaagcgctcctgaatgagatcggaaccgaggttagaagtcataatgaccaccgtattacggaagtcgaccgttctcccctgcccgtcagtcagtcgaccgtcgtccagcacctgcaacagaatgttgaatacatccggatgcgctttttccacttcatccaacaagatgacggaataagggcgacggcgcaccgcttccgtcaaataaccgccttcttcatagccgacatatcctggaggcgccccgaccaaacgagacacggagtgtttctccataaactcagacatgtcgatacgcaccatcgcgtcgtcgctgtcgaacataaagttagccagcgctttacacagttcggttttaccgaccccggtcggcccaaggaacaggaaggaaccaatcggacggttcggatcggacagccccgcgcggctacggcgtatggcgttcgatactgcttcaacggcttcattctgcccgatcacacggctgtgtaactcttgttccatacgcaacagtttttcacgttcgccttccagcattctggaaaccggaataccggtccagcgcgccagcacttcggcaatttccgcatccgttactttgttacgtaacagacgcatggttttaccttccgactgggtcgcggcttccagctgtttttccagctccggaattttgccgtactgcagttcagacattcgcgcgaggtcgccaacgcgacgcgcctgctcgatggcgatcttcgcctgctccagctccgctttaatagtttgcgtaccagagagcgacgctttttccgctttccactcttcttctaactcagagtactgacgctctttatcgtccagttcttcattcagcatatcgagacgttttttactcgcctcgtcagactctttcatcaacgcctgctgttccagtttgagctgaataatgcggcggtcgagcctgtccagctcctccggcttcgagtcaatctgcatacgaatgctggatgccgcttcatcgatgaggtcgatagctttatccggtaactgacggtcggcgatatagcggtgagataatgttgccgccgccacaatcgccgggtcagtgatctgcacatggtgatgcagttcataacgctctttcagaccacgcaaaatcgcaatggtgtcttccaccgacggctctgccacgaacactttctggaatcgacgttccagcgccgcgtctttttcgatgtactgacgatattcgtccagcgtggtggcgcccacacagtgcagttccccacgtgccagcgccggtttcagcatgttaccggcatccatggcgccatcagctttacctgcgccaaccatggtgtgcagctcgtcgataaacaggatgacgttgccttcctgttttgcgaggtcgttcagcacgcctttcagacgctcttcaaattcgccgcgatatttcgccccggccaccagcgcgcccatatccagcgccagcacgcgacggcctttcaggccttccggtacttcaccgttgataatacgttgcgccagcccttcaacaatggcggttttacctacgcctggctcaccgattaacaccgggttgtttttagtacgacgttgcaatacctgaatggtacggcgaatttcttcatcacgaccaattaccgggtcaagcttaccttgttcagcccgctcggtcagatcgacggtatattttttcaaggcctgacgttggtcttcagccccttgatcgttcacgctttcacctccgcgcatctgttcaattgcctgagtgatattggccgtagtcgcaccggctgatttcagcagatcggttaacgtgccgcgagactcaagcgccgccagaacaaacagctctgacgaaataaaattgtccccccgtttttgcgccagcttgtcgcaaaggttcagtacgcgtaccagttccgaagaaggctgtacgtcgccgccggtgccttccacctgcggtaaacggctcagcgcctgatcgatagcagtgcgcaactggccagcattaatgccggcggaggttaataaaggacgtatcgatcccccttcctggttcagcaaggcgctcattaaatgaagaggttcgatgaattggttgtcgtgccccagcgcgagcgactgggcatcggcaagagcaagctggaatttgttagtaagacgatccagacgcataactcctcccataacaggtcaaaattgctactggagattaaatgaggtcatccctcaattattcaaggtgaatgacctgaattatgtgaaaagaaagttacccgtaccggatcgtcttgattctttaggttatatcagccaaataaaacttgccatacgacctgtcgtcttgtcgcgacgataagagaagaaagtctcactttcgctaaaggtgcagcgatccccgccatagacatgttcaacgccagtattcgccagacgttggcgtgcaagctgataaatatccgccagaaatttttccccgtgcggcaaaaatgcgctatcggcttgcgcatcttttgctaaaaatgcgtcacgcacttccggccccacttcaaacgcggccgggccaatcgccggacctaaccaggcgatgatattttctggtttgtcagcaaagcaggtgacagtttcctccagtacgccttcacataatccgcgccagcccgcatgagccgccgccacttctgtcccctcacggttacagaatagcacaggcaggcagtctgccgtcattaccgcgcagacggttcctggcgtattgctgtaagacgcatccgcacgtttggaggcataaggttctccggtaagcctcaatacatttttaccgtgaacctgttcaagccagacaggtttcgaaggcagattgcccgccgcgaacagacgcttgcggttctcttcaacatgctccgggttatcgccgcaatgcgcgcccagattcagcgagtcgtaaggcgataaactcaccccaccaatacgggtagaactacaggctgcgacgcctttcggcagcggccactgcgggacaatcagtgcattcataaccagtccacatcatctttatgatcttcgaaatcggcgcgcatcgcatcgataaggtccaccatatcttgtggaatcggcgcgtgccactccatttcgatacccgatacaggatggtagagacgcagcatcgttgcatgcagcgcctggcggtcaaacttacgcagcgtggaaataaattcttccgatgcgcctttcggtggacgtggacgaccaccgtagacctgatcgcccactaacggatgcgtaatatgcgccatatgcacgcggatctggtgcgtacgcccggtctccagacgcaacctaagacgcgtgtgcacacggaaatgttccataatgcggtagtgggtcaccgccggtttgcccataggatgcaccgacatatgggtacgtttggtcgggtgacgactgatgggttcattcaccgttcctcccgccgtcatatgtccgatcgcgaccgcttcatattcgcgggtgatctcgcgcagctgcaaagactccaccaggcgcgtttgcgccggaacggttttggccaccaccatcagccccgtcgtgtccttatccagacgatgcacaatgcccgcgcgcgggacatccgcaatcggcggataataatgtagcaacgcgttcagtaccgtaccgtccgggttacccgcgccaggatgtaccaccagatcgcgtggtttgttgataaccagaatatcgtcatcttcataaacaatatctaacgggatatcctgcgcttcaaaacgaatctcttcgtcgatctccgcatcaatagccacccgctcgccgcctaacactttttcttttggcttatcgcaaagttgaccattgaccaacacgcgctgattcaaaatccattcttttatacgcgaacgtgaataatccgggaacatttcggccaaagcctgatctaagcgttgaccgagttggttttcggagaccgttgcggtgagttgtactcgttgtgccatatacagcttcttcgtttaacgttgggttttacggctttgccgtttaatatagtgtgctattgtagctggtcttaaccgggagcaggaacagagaatctcccgtaaaacattttgaggaaagtcaaaacgtcatgacgcgcatgaaatatctggtggcagcagccacgttgagcctgtttctggcgggttgctcgggttcaaaggaagaggtgcccgataatccgccgaatgaaatctacgcgactgctcagcaaaagctgcaggacggtaactggaaacaggcaataacgcaattggaagcgttagataatcgttatccattcggaccgtattctcagcaggtgcagttggatcttatctacgcctattacaaaaacgccgatttgccgctagcgcaggccgccatcgatcgttttatgcgtcttaatccaacgcaccctaatattgactatgtcatgtacatgcgcggcctgacgaacatggcgctggatgatagcgtgctgcagggtttctttggcgtcgatcgcagcgatcgcgatccgcaacatgcgcgggcggcgttcaatgacttttcgaaactggtacgcagctatcctaatagccagtacaccaccgacgccactaagcgtctggtattcctgaaagaccgtctggcgaaatatgaatattccgtcgcagagtactataccgcgcgcggcgcatgggttgcggtcgtaaaccgggtagaaggtatgctacgcaattatcctgatacgcaggccacgcgcgatgcgttgccgctgatggaaaacgcctatcgtcagatgcagctgaatgcgcaggctgacaaagtcgcgaaaattattgccgctaacagcaaaaacacctgaagcaataccaacaagcaaaacggcagccttccggctgccgtttttttattcgatatctgatgcaacagaaatgatttcactgcaacgcatccagtcaaatatggcctgctttcagccattcctcaagtaaaagatcgcttcttcctgcgatgcctcacaaaaagttcgccttgacaaaaagtgacaaaataatgtgatttacatcacacattttgacattaagaacggtatgctggaatcaccaagacgggaaagacaagaggtaaaatttatgacaatgaacattaccagtaaacaaatggaaattactccggcaatccgccaacatgtcgcagaccgtctcgccaaactggaaaaatggcaaactcacctgattaatcctcatatcattctgtctaaagagccacagggctttattgctgacgccaccattaatacaccgaacggacatctggtcgccagcgcaaaacacgaagatatgtacaccgctattaatgaattgatcaacaagctggaacggcagctcaataaagtgcagcacaaaggcgaagcccgtcgtgccaccgcatcggtgaaagatgccagcttcgtcgaagcagaagaagagtagtcccttacattgagtgtatcgccaacgcgccttcgggcgcgttttttgttgacaggattaaaacagtacgggtactgtacttacgtacacaaaggaaacagttatgaagctcacccggtttttcttcgcattcttttttatcttcccctgaccgggaggcgtttcgtcatgtgataaagaatgcgaagacgaacaagaaggcctcccccaccgggaggccttttttattgataacaaaaaaggcaacactatgacatcggaaaacccattactggcgctgcgagataaaatcagcgctttagacgaagagttactggccttactggcaaaacgacgcgcgctggcgattgaagtgggacaagcaaaactactgtcgcatcgtccggttcgggatatcgatcgtgaacgcgcgctgctggacagactcatccatctcggtaaagcccaccatctcgacgcacactacattacccgtctgttccagcttatcattgaagactccgtgcttactcagcaggcgctgctgcaacaacatctgaataatactcaccctcattcggcacgtattgcgtttcttgggccgaaaggctcctattctcatctcgcggcgcgccagtatgctgcacgccattttgagcaatttattgagagcggttgcgcaaaattcaccgatatttttcatcaggtcgaaaccggccaggccgattacgccgtggttccgatagagaacaccaactccggcgctatcaacgatgtgtacgacttattgcaacacaccagtctgtcgattgtcggtgagatgaccgtcactatcgatcactgcgtgctggtttccggcgctacggatctgaataccatcgaaacggtgtacagccatccgcagccgtttcagcagtgcagtaaatttttgagccgctatccgcactggaaaatcgactataccgagagtacgtcggcagcgatggaaaaagtcgcgcaggcaaactctccgcgcgtcgcggcgctcggcagcgaggcaggcggcatgttgcacggtttacaggtgctggaacgcatcgccgcaaaccagacacagaatatcacccgctttctggtactggcgcgcaaagccatcaacgtttccgatcaggttccggcaaaaaccactctgttaatcgccaccgggcagcaagctggcgcgctggtcgaagcgctgctggtgctgcgtaaccacaatctcatcatgacgaaactggagtcgcgccccattcacggcaatccgtgggaagagatgttttatctcgatattcaggcgaacctggagtcgcaggtaatgcaaagcgcgctaaaagagctgggcgagatcacgcgctcaatgaaagtgcttggctgctatcccagcgaaaacgtcgtgccggtagaacctgcctgacgttcaataaaacggcttttcttcatccctgcgacggctacctgcagggtgaagatggcgccggagagcggataatccgccacttcctgagcagacatattttctctggtagttgtaataaacagcgttttcatatctgcgccgccaaagcaaaccatcgtcggacaacgtaccggcaaccggtactcttccagctgctctccttgcggtgagaaacgcgccacgcgccagccgtcaaacatcgcgctccagtagcacccttcgctatccatcgccgcgccgtcgggaagtccttctccttcgccaaaatggcgaaaaagttcacgcttgcccggttcgccatgcttatcaagtaacgtgcggtatatcacgccattcggcgtatcggaagtatacatccactggttgtccgggctgaacgccaggccgttgtgtccctggataccgcactggatcacttttgccgtcaggtcatgatcgatccgcatcagcaacgcgccattatagtcacccggcgcccagaacgttccggcataaaaacggccatcgccatcagtgccgccatcgttgaaacgcgccagtttcgtattagagggattgtcgcaaaccttacgctgcaataatccatttttatcggccagccaaatagcatgacgcatggccacaataaatccgccctgctcacgcaaggcaaaacagcctacctcttccggaaacgccagcacgctatgcgtcccactcgccggatggtaacgatagatctcctgttccaggatatcagtccaatacagcgcgctttcatcctcgctccatgtggggcattctggtaaatgtccgacataatcaaataaaaggtgcggcgtagtcataacggttccttaaacgaaaaaagccagcaaagctggcttttagtatagatgtcatcattatggtcggctgtcattcgcctgacgtaataacacacggctttcattctggaagcgtctggcataatcgccaaaccagtgttcaactttgcgaaaactgtcgataaaagcctgcttatcaccctgttccagtaacccgatcgcatcgccaaaacgtttatagtaacgcttgataagcgccagattgcgctccgacgacataataatgtctgcatacagctgcgggtcctgggcgaacagacgcccgaccatcgccagctccagtcgataaatcggcgatgatagcgccagaagctgctcaagctggacgttctcttccgccagatgcagcccataagcgaaggtagcaaagtggcgcagcgcctggataaaagccatgttctgatcgtgctcgacagcgctaattcggtgcaaccgcgcgccccacacctggatttgctcaaggaaccactgatacgcttccggttgacgcccatcacaccagaccaccacctgcttcgccaggctcccgctgtccgggccaaacatcgggtgcaagcccagcacggggccatcatgggccgccaacattgcctgtaacggaccgcttttcaccgatgccagatcgaccagaatacagtcggacggcaggggcggcagttgcgctatgacctgttcagtaacatgaatcggcacgctgacgatcaccattccggcatcggcgacaatgtccctggcgcgcggccagtcctgttgttccagaatacggacctgatagcccgacagcgtgagcattttttcaaacagacgccccatctgtccgccgccgcccacaatgacgaccggacgcagagaaggacaaagcgttttgaaccccttatcattttcgctggagtaagattcacgcattacccggcgcaggacatcttcaatgagatcgggcgggacaccgatcgcttctgcttccgcccgtcgtgaagccagcatagaggcctcacgctccggcacgtaaataggcaggccaaaacggcttttcacctcgccgactttggcaaccagttccaggcgcttagccagtaaattcaacaacgctttatcgacatcatctatttgatcgcgtaacgcggtcaattcagcaaccataacaacctcttatgcgacgcgcaccgccagctggccgctcaaatctttatgaatttcacgtaacagggcatcggtcatctcccagctaatacaagcatcggtgacggaaacgccatacttcatttcgctgcgcggctgttcggaagactgattaccctcatgaatattactttcaatcattaagccaatgattgaacgattgccatctttaatctgcgcaaccacagattcggcaacggctggctggcggcgataatctttattggagttaccatgactgcaatctaccatcagcgaaggacgtagccccgcctgttccatctctttttcacactgagcgacatctgccgggctatagtttggcgctttgccgccacgcagaatcacatggccatgcggatttccctgggtttgcaataacgcaacctgaccggcctggttaatgccaacaaaacgatgaggttgcgcagcggcgcgcatggcgttaatcgctgtcgccaggctgccatccgtgccgtttttaaagccgaccggcatagaaagaccagacgccatttcgcggtgggtttgcgattcggttgtgcgcgcgcctatcgccgaccagctaaacagatcgcccaggtattgcgggctgttcggatccaacgcttcggtcgccaatggcaaccccatattcaccagttccaccagtagctgacgcgctattttcaacccggcttccacatcaaatgagccatccatgtgaggatcgttaatcagccctttccagccgacggtagtccgcggcttttcaaaatagacgcgcattaccagatagaggctatcgctgacctctgcggcaagggctttaaatcgacgggcatattccagagcggtttcaggatcgtgaatagaacaaggaccgcataccaccaacagacgcggatcgcgcccggcaataatgtcagaaatgattccccgggactgcgctatctgcgcttcctgcgccaggctcaacggaaaggccgctttaagctgctccggcgtcattaatacctgttcatcggtgatacgtacgttattcagcgcgtctttttgcatgatggcgatcctgtcttttcttgtttgcgatagttgatcctccacgaggatgtttaaaccataccacaaaaagtaaagatttcaatccatattacgtaaaataaactttacatagtgctaaatcgtcgattaaacctctcaatttcgtatcaaaaactttacacaacaagtgaattattttattcccagcttcagaaaagcggtaaaatgagcgatgctcgctattttttgattattttttctccgcacgcataattttactttctgatatagggtgattaataccattatcacaagaatttaatatcagggatgccacttaaattattcatattatcaataagacataatgacgatatggcaaaataatgttattttgctacaaacaatcacggatgtattttaatgttttacgactgaagatggtggggacttgttaatgcgtttttctcaccgatttatccttctgttatcgctattattagcaagcttgcctctgtatgctcaatgtgtcacggaagaagagaaatccgtacgcgccattgtctccggtatcgtcagttatacacactggccagcgttatccgggccgccaaggctatgcatattttcatctgcgcgttttgtcagggtacttagcgaagaggctaactgggctttcccttatcaaccgcttgtcatccgtaccacacaagaagccctgagcgcccgctgtgatggtttttactttggcaatgaatcgccagcttatcaggtggagttaacgcgtcattatccagttaatgccttgttattaattgccgagcaaaataccgaatgtattattggcagcgcattttgtctgatcattaacaatgatgaagtcaaattttccgtcaacctggactccctctcgcatagcggcgtgagagtgaatccagaagtattaatgcttgcacggaatcaaaagcatgaataaggaattttctctgtccagaccaacatttaaacgcacactacggcggattagtataatcagcgtgctgcttacaatgacattgatctggctattaatttgcgttgcgtctgtccttacgctcaaacagtatgcgcaaaagaatctcgatttgaccgccgccacaatggcccatagccttgaagcggcactggtattttccgatagcgcggccgcagcggaaacgctcgccacactgggacgccagggacaattttcagcggcggaggtccgcgataaaaatggccgtactatcgcctcatggcgatatgatgcgcgagccgcagacgataagctcatcggcttaattagccactggctttttccattgccggtatcgcaacccgtctggcacaacggcagggctatcggcgaagtacggcttgtcgcccgcgacagccttattggtcattttatctggctatcgctggcagtgctgacaggatgtattctgctagcatccggcattgccctgctactcacgcgttatttacacaatggcgttgtggatgcgctacaaaatattactgaaattgtacacgacgttcgcactaaccgaaatttttcacgccgggtacctgatgagcgtattgcggaatttcacctgtttgcgcaggatttcaatagccttctggatgagatggaagaatggcagctacggcttcaggctaaaaatgcacaattactacgtaccgcgttgcacgatccgctgacggggcttgccaatcgcgcggcatttcgcagctgtattaacgcgctgatgaaggacaattccgctcgtagcagttcggcattgttatttctggatggcgataactttaaatatattaatgatacctggggacatgcggcaggcgaccgcgtacttatagaggttgccaaaagattagcggaattcggtggtagccgttatcagacttaccgactcggcggcgatgaatttgcgatggtgctttacggtgtacattcggagtatgaagtacaacgtatttgcgcagcactatcccaggcgtttaatcgaccttttgaactgcataacggccagcgaataacgatgaccctgagtattggctttgcgctgacatgggaacatgccactgccgaaaaactacaagaactggccgatcgaaatatgtatcaggctaaacaccggcgtgcagaacgctcgctaaactaaggaacgggccaggccgtttctgactcagcgttgataccacagacccagcttaatcatgcaaccgtctatggcgtggagcaacccataaaaaaaggggccagcgtaatgccagccccttcttttctacaagctttcggatgttgcgaaagcgcgttcttagttaagacgctctttgatacgagctgctttaccagtacgctcacgcaggtagtacagtttagctttacgaacagcaccacgacgtttaacagcaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgtttcttggtaccttcaacaacccatactttcacttccacggtatcgcccggacggaaggaaggtacgttctgcttcatctgctcttgttcaagttgcttaataatgttgctcataatttaatctcttatcctgggtaaactgatattcgggggcctatgccatcccatcatgtttatgctgctgttgtgcgtgttctgttttgaactccgccagcaaccttgcttgctcttcagtcagagccaggttttccagaagttcaggtcttctaagccaggttcggcccagtgactgtttcaaacgccagcgacgtatctcagcatggtttcccgacagcaatactggcggtacttccatcccctctaacacttcagggcgcgtatagtgcggacaatccagcaacccatcagcaaacgaatcttcgattgctgatgcctcatgccccagaacccccggtataaaccgggcgacggagtcaatcagcgtcattgccggtagttcgccaccgctgagaacgtaatcgccaattgaccattcttcgtcaatttcggcctgaattacgcgctcatctacgccttcgtagcgaccacacaccagaatgagtttctgattcgtggccagctcgctaacgcccgcttgatcaagcttgcgtccctgaggcgacagataaatcactttagcgccttcacctgccgcggcttttgctgcatgaatggcgtcccgcaagggttgcaccatcattaacatccccggtccgccgccgtaaggacggtcgtccacggtacggtgccggtcatgcgcgaagtcgcgaggactccagctttggatgttcagcaggcctttttttactgcccggccagttaccccgtaatcggtaattgcgcggaacatttcaggaaacaggctaacgatgccaataaacacaagccaatccccataacgccatttattaccgtttatccggtggtttaaaaaccaggatcccagtctacttcgatagtacgagtagcgagatcgactttcttgataacctgcccatcgaggaacggtactagtcgttccttgataccaaatgcatctttcaggttcgccttaatgacgagaacgtcattcgacccggtttccatcatgtcgataactttaccgagatcgtagccttcagcggtgactacctggcaacccatcaggtctttccagtagtagtctccctcctcaagcgcaggaagttgcgaggaatccacgacaatttcgcaattggtcagaagattcgcggcatctcgatcgtcaacgcctttcagcttgatgatcagatcctgattgtggtgcttccagctttccagctgtacctgctgccactgacccgccttctggataaaccagggctgatagtcaaaaatgctttcggcgtcttcagtggaggaaaacactctgagccaaccacggataccgtatgaagaacccattttccccagtacaaccggttcagcgggtacttgtgcggcgagttgcttgctcatcatgaccaccgtgacagattaagctgctttttttacttctttgatcagcgccgcaacgcgatcggaaatggttgcgccctggccaacccagtgagcgatgcgatccagatccaggcgggtgccttcttctttttcgctagcgattgggttgaagaaaccaacgcgctcaatgaagcgaccgttgcgtgcattacggctgtcggtgacaacaacctggtagaacggacgctttttagcgccgtgacgagctaaacgaatagttaccataacatcctcttgtgtgaataaaacaaccgggcctcatcgaggaacggagcccggcgtcatattaaaagcccgaaaattttactgatttctggggaaaatgcaatcagcatcttgctactgaacacgaaacaagggataaaaggcgtatatcggtgcagccagtttagctccggcgtgcgcgcagaaagcggagcgtacacgcagtacgtgagcatttcgagcacaccccggggctaaaatggcaaacaagatagccttatacccttgttttagcggccacgcagtacgtgaggatggctagcacaccccggtgccgaaatagcaagtgagcctagccgggaaattagcggcctggaaaaccaggcggcatcatccccttcatactccgcatcatcttcgccatcccgcccttcttcattttcttcatcatgcgctgcatgtcgtcgaactgtttcagaaggcggttaacgtcctgcacctgcatcccacagccctgcgcgatacgacgcttgcgggaacctttaatgatttccggcttcgcgcgttctttcagcgtcatcgaattgatgatcgcctccatacgcaccagcaccttatcatccatctgcgatttaacgttgtccggaatctgccccatgcccggtaatttgcccatcagactggccataccgcccatgtttttcatctgtttgagctgctccaggaagtcgttcaggtcgaaaccgtcgcctttcttcagtttggtcgccagcttctcagcctgtgcgcggtcaactttgctttcgatatcttcgataagagacagtacgtcgcccatgccgagaatacgcgaggcgatacgatccgggtggaacggctccagcgcgtcggttttctcgccgacaccgaggaatttaatcggcttgccggtgatatgacgaatagagagcgccgcaccgccacgcgcatcaccatcaactttggtcagcaccacaccggttaacggcagcgcttcgttaaaggcttttgcggtattcgccgcatcctgaccggtcatcgcatcgacgacaaacagcgtttctactggcttgatagaagcgtggacctgtttgatttcgtccatcatcgcttcgtcaacgtgcagacgaccggcggtatccaccagcagcacgtcgtagaatttgagcttcgcttctttcagcgcggcgttgacgatatcaaccggtttctggccgacatcagacgggaagaaatccacgccaacctgctcagccagcgtttcgagctgtttgatcgccgccgggcgatagacgtcggcagagacgaccagcactttcttcttgtgcttctcgcgcaagaatttacccaacttaccgacgctggtggttttacccgccccctgcagacccgccatcaatactacggctggcggctgcgcagccagattcagggtctggttttcttcgcccattgccgcaaccagttcgctacggacaatcttgacgaactcctgccctggggtcaggcttttgttaacttcatgaccaaccgctttctcttttacgcgattgatgaactcacgcactaccggcagcgcaacgtcagcctccagcagcgccatgcgcacttcgcgcagcgtctctttaacgttgtcttcagtaaggcgcccacggccactgatattgcgcagcgtgcgcgacaaacgatcggttaaattatcaaacattgtctctcgcctggggtggaaacggttggtcgccgcagcgacacagttacagaatttcgccacagtataccatgaagccgtctttgttgttatgcaacggttggagctgcggtcacgtaacgctatactgcttctctttctcactggtcaactgtcgacacaactatgcccgtttttgctttacttgcccttgtcgcctactccttcagcctcgcgctgatcgttcccggactgttgcaaaaaaacagcggctggcggcgtatggctattctttctgcggtcatcgcgctggtgtgccatgctgtcgcgctggaatcgcgtattctgcccggcggcgacagtggacaaaacctgagcctgctgaatgtcggttcgctggtcagcctgatgatctgcacggtgatgaccattgtcgcgtcgcgtaatcgcggctggctacttctgcccattgtctatgcttttgcgctgattaacctggccttcgccacgttcatgcctaatgaatatattacgcatctggaagcgaccccaggcatgatggtgcacatcggtctgtcgcttttctcttacgcgacgctgataatcgccgcgctgtatgcgctacaactggcgtggatcgactatcagttgaagaacaaaaagctggcgtttagtaatgaaatgccgccattgatgagcattgagcgcaaaatgtttcatatcacgcagattggcgtcgtactgctgacccttactctgtgtaccggcctgttttacatgcataacctgttcagtactgaaaatattgataaagccgtgctctctatcgtggcatggtttgtctatatcgttctgctgtgggggcattaccatgaaggctggcggggtcgtcgggtcgtgtggtttaacgtcgcaggcgcgggtattctgacgctggcctattttggtagccgcatattacagcaatttgtaagctaagcttttaaaggagtttcccctggaacacatctccaccaccacgctgattatcatattaatcatcatggtggtcatctcggcctatttttccggttccgaaactggaatgatgacgctaaaccgttaccgtttacgccatatggcgaagcaaggtaatcgctcggcaaaacgggtagaaaaattactgcgtaaacccgaccgactgataagcctggtgctgattggcaataacctggtcaacattcttgcctcggcgctcggcacgattgtgggtatgcggctttacggcgatgccggcgtggctatcgccaccggggtactgacgtttgtcgtgttagtttttgccgaagtcctgcccaaaactatcgccgcgctctatccggaaaaagtggcctatcccagcagcttcctgctggcgccgttacagatactgatgatgccgctggtgtggttacttaacaccatcacccgcctgctgatgcgtctgatgggaattaaaacggacatcgtggtcagcgggtcgttaagcaaagaggaattacgcactatcgtgcatgaatcccgttcgcaaatctctcgccgcaatcaggatatgctgctgtcggttctcgatctggaaaaggtcagcgtggatgacatcatggtgccgcgtaatgaaattatcgggatcgatatcaatgacgactggaagtctatcgagcggcagctcacccactcgccgcacggacgcattgtgctctatcgcgattcgctggatgacgccatcagtatgctgcgcgtgcgtgaagcctggcggttaatggccgagaaaaaagagttcaccaaagagatgatgctgcgcgccgccgatgaaatctattacgtcccggaaggtacgccgctcagtacgcaactgattaaatttcagcgcaataaaaagaaagtcggactggtcgtcaacgaatatggcgatatccaggggctggtcaccgtggaagatattctcgaggagatcgttggcgacttcaccacatcgatgtcgccgacactggcggaagaggtcacgccgcaaaacgacggttcggtcattattgacggtaccgccaacgtccgggaaatcaataaagcgtttaactggcacctgccggaagatgacgcgcgcaccgtcaacggggtgattctggaggcgctggaggaaattccggttgctggcacgcgcgtgcgcattgagcagtacgatatcgatattctcgatgtacaggaaaatatgattaagcaggtaaaggttgtaccggtaaaaccgctgcgcgagagtgtggcggagtaacacaatggcgaactccggttcgccttttttatcgccgtcttttaagattccatcaattcctgccatttacttaacaatgcaataatgtcttttcaggcattcagaaaggatattgatgttatgtcagaagattatgtaattgaatgggataagaattttgcagacgacctcaacgtcgtcgccaacgtttttttatcgcacaacccaaccttatggcccactattttctctcaactttcgacgcaacctgaaatctttgaagacgaagatgaagacgaatatgggttgcaagacgtcctggattgtagcggtggcgatctcggaaataacgagctggcacaggcatttttacaagttctacgcggcgaaggatttattcacctcgttgactggaaaggtgaagatgaagaaggcgaactggctaattttgccgcagatcgcttttatgaactcacaaaaaacctgacggattctgaggaattaagaaatcttcttgtcgaaataacccaagaggatgaaatctccgatgtctgtgaagccggggaccgttaccttgacgagatctttgaacgcatccagaccgaactcaataagaggggcttccagatttttgatctgaatgaaggatctgacacctataatgtggtcgttctgccaatgagcgaatataaaaaatagaggatttcaacacgccgtggctggaagtgcaggattttttaagctaaaaaaatggccgactttacatcggccattagacttttacttcgccttcgctacagtcaccatcgccgcgcgaatggtacgaccgttcagcgtgtagcctttctgcataatacccagcacattgcctgccggaacctcttccgattccaccatcgcaatcgcctgatgcacgttcgggtccagcggcacgttggtctcagcaatcacttccacgccgaacttacgcaccacatccagcatagacttcagcgtcagctcaatcccttcgaccattgccgccatatccggattggctttgtctgcgacttccagcgcgcgatccaggctatcgattaccggcagcaattcgttgacgaacttctcgagagcgaatttatgcgctttttcgatatcctgttcagtacggcggcgcaggttttccatttccgctttgatacgcaacacggtgtcgcgttcgcgagtctgggcttcggcaagctgaacttccagattcgcaattttttcatcgcgcggatccacctgctcagcagaatcgtttggttcaactgcctcaacctcttcgtgctgatccatgataatttcttccggggcttgcccctcaggcgttttctgttctttactactcatgaatttctccgcgttttttttcgcattcatctcgctaacttcgcttattatggggatcagattcagggtttcaagggaagtactcacattgtcatcaatcttcgctacaaggacctcagaaaaatgaataatcatttcaagtgtatcggcattgtggggcatccgcgtcatcccaccgcactcacgacacatgaaatgctctaccgttggctatgcgatcagggttatgaggtcattgtggagcaacaaatcgcccacgaattacagctaaaaaatgtgccaaccggcacgctggcggaaattggtcaacaggcggatctggcggtagttgtgggcggcgacggcaatatgcttggcgcagcgcgtacgctggcgcgttatgacatcaatgtgattggcattaaccgcggtaatcttggcttcctgaccgatctcgatccggacaacgccctgcaacaattatcggatgtgctggaaggacgctatatctccgaaaaacgttttctgctggaagcgcaggtctgccaacaggaccgccagaagcgtatcagcacagccattaatgaagtggtgctgcatccgggaaaagtggcgcatatgatcgaattcgaggtttatattgatgaaaccttcgctttttcacagcgatctgatggtctgatcatttctacgccgaccggctccaccgcctattcgctctccgcaggcggccctattctgaccccttcactggatgccatcaccctggtgccgatgttcccgcataccttgtcggcgcgcccgttagtcattaacagcagtagcacgattcgtctgcgtttttcgcatcgccgtagcgatctggaaattagctgcgacagtcagatagcgctgcctattcaggaaggagaagatgtgctgattcgccgctgcgactaccatctcaacctgatacatcccaaagactatagctatttcaatacattaagcacaaaactcggctggtcaaaaaaattattctaattttacgttagcctctttactgtataaaaaaccagtttatactgtatttaattacagtcatggtttttcatacaggaaaacagctatgttggcgcaactgaccatcagcaattttgctatcgttcgtgagcttgagatcgattttcagagcggaatgaccgtcattactggtgaaaccggcgcgggtaaatctattgcgattgatgccctgggtctgtgtctgggcggtcgcgctgaggccgatatggtccgtaccggagcgacccgcgccgatttgtgtgcccgctttgcgctgaaagacacgcctgcggcattgcgctggctggaagaaaaccagcttgaagaaggtcgcgaatgcttacttcgccgcgttatcagcagcgatggccgctcacggggctttattaacggcaccgctgtgcccctatctcaattgcgcgagctcggtcagttgctgattcaaattcatggtcaacatacgcaccagcagctgaccaaacccgaacagcaaaaatcgctgctggatagctatgccaacgaagccgctttagcgcagcagatggctgcccactaccaattatggcatcaaagctgccgcgatctcgcccatcaccagcaacaaagtcaggaacgcgccgcgcgcgcggaactgctgcaatatcagttaaaagagttgaacgactttaatccgcaggccggcgaattcgagcaaattgacgaagagtacaaacggctggccaacagcgggcagttgcttacgaccagccagaacgctctggcgctactcgcggacggcgaagacgttaacctgcaaagccagttatatagcgcaaaacaactggttagcgagctggtgggtatggacagcaagctttccggcatcctggatatgctggaagaagccactatccaactcaccgaagccagcgatgaattacgccactattgcgagcgtctggatttagaccccaatcgcctgtttgagcttgaacagcgcatcgctaaacaaatttcgctggcgcgaaaacatcacgtcagcccggaagcgctgccgcagctttatcagtcactgctcgaagaacagcagcagctcgacgatcaggccgattcgctggaaacgctgacgctggcggttaataagcatcaccaacaagcgctggaaacggcgcaagcgctgcatcaacagcgtcagttttacgcccaggagctggggcagttgatcactgaaagtatgcatttactttcgatgccgcacggtctgtttactatcgacgtgaaatttgatgagcatcatctgagcaacgacggcgccgatcgcgtggagtttaaagtgacgacaaacccgggtcagccgctgcagcctatcgctaaagtcgcgtctggcggtgaactgtcgcgcattgcgctggctattcaggtgattaccgcgcgcaaaatggaaacgccggcgctaatttttgacgaggttgatgttggcatcagcggcccaaccgccgccgtggtcggtaaactcctgcgtcagcttggcgaatccactcaggtgatgtgcgtcactcacctaccacaggtagccgggtgcggtcaccagcacttctttgtcagtaaagaaacagacggggcaatgaccgaaacccatatgcaacctttggataaacgtgcgcgtttacaggaactggcccgcctgttgggaggaagtgaagttacgcgtaatacgctggcaaacgcaaaagaactgctggcggcgtaaacttttttatctcccgaaggtctgagttcacaacaaaaacgccgtaagacccgacagcaaaaggttttaaagtgatgaaaggtctattatcatcggcatattaatatgagccacgtactgctcaggcccgaaaaggaacccaatcactatgcgctgtaaaacgctgactgctgccgcagcagtactcctgatgttgaccgcaggctgttccactctggagcgagtggtttaccgacctgacatcaatcaggggaactatcttacacctacggatgtcgccaaagtgcgtgttggtatgacgcaacaacaggttgcgtatgctttaggcacgccgatgatgaccgatccttttggtacgaacacctggttttatgtcttccgccagcagccaggacatgagaacgtgacgcagcagactctgacgctcacctttaacagcagcggcgtgttaaccaatattgataacaaaccggcgttgacgaagtaattttgtgataccgcctgatgaggttacgttcatcaggcctgcaaacctctcccccgccatttggtacgaatttgcctgatggcgctacgtttatctggcttacaggcacgcctgtgcttcaggtgtggtacggctttcacaccgttatccggcaaaagaggctaattatctgccagccgatttttcggcacgctggcggcgtaatgcttttggatcggcgattaagggacggtaaatttcaacccgatcgccatcctgcaccgtatcggtgagttttaccggacgactgtagatacctactttatttttcgccagatcgatatccgtgcgcaattccagcaagccggaagcgcgaatcgcctcttcgaccgtcgcgccctcctccagcgttacgcgctgcaaatactgcttttccggcagcgcataagccacttcaaccacaagtttatccagcacggtaaacctctttggcgcgaaccgtaaacgcctgcaccatgttggacgctaactctttgaatatacgaccaaacgccagctcaatgagtttattggtaaactcaaaatcaagctgaaactcaatgcggcacgcctcggggctgagcggggtaaatttccagccgccgatcagctttttaaaggggccatccaccagatgcatcagaatactctggttacgcgttagctgattacgcgtcgtaaacgtcttgctgatacccgccttcgacacgtcaacagccgccgtcatctgtgctggcgatgactccaggacacgactgccaacacacccaggcaaaaactggggatacgattgcacgtcattcactaactgatacatctgttccgcactgtaggggactaaagcagtccgactaatctgaggcatagcaattcccatcaacataaatcgtgtaaataataccacttatcagcgagtaaaaaaaatgctgtccccaaccgtcatgccttaattgtgcgtgcatagcccaactcatgctaagatagatttttgcacctcatcaggacgtaatggggtgttttcgatatcagattacctatgaattcacgacacttatgacgaagaaaaaagcacataaaccgggctcagccaccatcgcgctgaataagcgcgcccggcacgaatactttatcgaagaagagttcgaggctggtctcgccctgcaaggctgggaagtaaaatctctgcgcgcaggaaaagccaatatcggcgacagttacgttatcctcaaagatggcgaggcctggctgtttggcgcaaactttacgccgatggcggtcgcctcgacacatgtcgtatgcgacccaacccgaacccgcaaactgttgttaaatcagcgtgagcttgattcgctgtatggccgtattaatcgtgaaggttatactgtcgtcgcgctttctctgtactggaaaaatgcctggtgcaaagtgaagatcggcgtggcgaaaggtaaaaaacaacatgataaacgttccgatcttaaagaacgtgagtggcaactggataaagcacgcattatgaaaaatgcaggccgataatagacattttttgtgaccagcttctcagtatgaagctggtcaatgttcatatctcatgcatgcctcgaaaatatattctctgtgtctgacgcttatcaatagcaataaataccacaccacaacaagaatatattctttgtttaaaaaatttttatagcctaataacacaatacttcaaatgatttttataaaatttaatattgctgaataccttcacaaaaagtattgtttttatgttaaaagagaaaaagaagaaaaaattaaaattcattataaaacataaagataaataaaaaattatcatgcattgttagcccaccctacctctccttaacacaaactccgttatatttcagacgcactaacacctttatcaatagatcttaatttgcagaaagatttttttctgactatatcatctaatacgaaagcactagtcaggcacaaaaaacaaatggttattcgacgagaaaaccagaccttcacctacgctcataaaaaagaatatggctacggaaattcatctctcacgataaacgggaaggctcgtctacgcattttgccctgaacgtcgtgcccgttaattaatacacagagcaaatccatcaggagctaatttatgcgtctactcgccgtggtttcgaaattgactggcgtctccaccactctggaatcctcagcggtcactcttaacgcgccttcaattgttaaattatcagtggcccgggatgaaattagtcaacttacgcgcattaatcaggatctggtggtgaggctccattccggcgaaacgatcacgattaaaaacttttacgttaccaacgatctgggcgcaagccagctggtactggcggaaaacgatggcacgttatggtgggtggaaaatccgcaagccgggctacattttgaacaaatcgctgatattaatgagctgctggtcacttccggcgcttcccatgaagcaggcggcgccgtttggccgtgggtactggctggcgcggtggcggctggcggcattgccgctatcgcgtcttccggcggcggcgattcccaccatcattcggatggcgataatccgccccccgataacaccaatcctgacggtaatccccctgataacagcaatcccggcggcagtaaccctaacggcaatactccaggtagcagtaatcctgtagatactaccccgcctctcgctcccggcgaattattgatttcagcggacggaaaaacggtgagcggcgaggccgaagcgggcagtctcattaccatcaaagatccctcaggcaacgtcgttggcgagggcaaagcggatagcgacggtaaatttagtattgatctgacagcgccacagattagcggcgaacaacttaccgtgactgcgactgacgatgccggcaataccggcccatccgcaaccattgatgcgcccaacattcctctccccgatacaccggttatcaccgccgctatcgatgatgccgctcccctcaccggcacgctgagcaataatcagtttacgaacgacaatacccccactctggagggcaccggcagcgcaggcacagtcatccatatttacgccaatggtcaggaaataggctcaacaacagttgataccagcggaaactggcattttgccattaccagcgcgctagcggatggggaaaatcatttcaccgccattgcgactaacgttaaaggcgaaagtagcgaatcagcccgctttacgctgactatcgacacactcagccccgatgctccacgcgttgaactgatggccgataacaccggtttgctcaccggaccgctacagaataatgaccggactgacgaggcaaaaccgctattttccgggcagggagaggcaggcaataccatcacgattaaagagggttcaaccgttatcggcagcgctaccgtagacgaaaatggacgctggacctttacgccgactacgccgttaagcgatggcgaacatacctttaccgtcgaacagagcgacaaagccggaaacgcaagccgcgtgacgacaacgcctactatcattgtggacaccacgccgccggacgccgctatcattgataatgtcgcgaaagacggcacaaccgttagcggcaccgctgaagctggcagtaccgtgtcgatctatgacccggcgggaaattacctgggctccacgattaccggagaaaataaccacttcagcatcacgctgaatccggcccagacccacggcgagcgtctggaagcgcgtattcaggacgccgtcggtaacatcggccccgccacagagtttaccgcttctgactcacagtatcctgcccagccgactatccttaccgtgacggatgacgctggcgccgttaccgggctgttgaaaaatggcgatgccacagatgataaccgcccaaccctcagcggtactgctgaaccaggcagtacgatatcgattaacgataatggctttcctgttccgagctttccgcccattgtcgctgacgctgacggcaaatggagctttaccccctcgctggcgcttgccgatggcgaccatgtctttaccgctaccgcgaccaacgatcgcggcactagcgggcagtccgtcgcctttaccattgatatcgacacgcagccgccggtgctggaaggcctggcagttagcgacgtcggcgacagactcaccggcactacggaagctggcagcactgtggttatcaaagatagcctgggaaatacgctcgggagtggaacggcaggcgacgacggcaccttctcaataggtattagcccggcgaaaattaacggtgaaacattaagcattagcgttaccgataaagccgcgaatagcggtccggtagaaacgctgaacgcgccggataaaactgcgcctgcggcaccgaacggtcttatcgtggcgaccgacggtctgtccgtaagcggtcaggcggaagccggggcaacggtcactatccgcgacagtagcaataccgtacttggcagcgccgtcgctaacggcaacggacaatttatcgttccgctgaatgcggcgcagactaacggccaggcgcttatcgctaccgccaccgatatagcgaacaacgaaagcgccgccgcgacggtcgacgcgccggacagtaccgcgccagaaatgccgaaaaacgtggtaattagtgaggatggcgccagtatcagcgacaccgccgaaccgggtagctccattacgatcaccacgccggacggcacgccgctcggcagcggcaaagcagatggcgaaggtcattttacccttcccctcgcccccgcacagaccaacggcgaacaggttaccgtcaccgccaccgacagcgccaacaacgtcagcccgccaactacagcgcaagcgcccgatatcaccgccccggataagcccattatcacccaggtgctggacgatgttgaaagcttcaccgggccgctggttaacggacaaaccaccaatgacaaccgccccacccttagcggtacggcggaggctggcgcgcgtgtcgaaatttttgataacggcgtttcgctggggctcgccacgctacagcccaacggcggctggacgtttacgccgtcgcaaaatttaggtgaaggcgcgcatcgactgaccgtaatcgcaaccgacgctaaaggcaatgccagtccggcggggaacgaaagtccggaatccatcagctttaccctacgcatcgatacccaggcgccggatgcgccgcagatcgtgtcagccgccatcacaggcggagaaggcgaggtgctactggcaaacggcagtattaccaatcagcgtatgccgaccctcagcggcaccggcgaacccggcgccatcatcaccctgtacaataacggcgtagaactggctaccgtccaggtcaatccacagggtagctggacctatccgctaacccgtaatctgagcgaagggttaaacatcctgacggccaccgccacggatgccgcaggcaatagtagcccgacctccggcgttttctccgttacccttgatacccagcctccagcgcagcctgacgcgccgctaatcagcgataacgtcgcgccggttatcggcaacatcggcaataatggcgcaacgaacgataccacgccgaccttcagcggcacgggagagatcggcagcacgataattctctacaataatggcagtgaaattggtcgcacaacggtaggcgataacggtagctggaactttacgcctgcggcactgacgccagaaacctataccattaccgtcacggaaaccgatatagcgggcaatatcagtccaccttccgcctcagtcacttttacgctagacaccactgcgcccgccaatccggttatcacttttgccgaagataacgtcggcgaagtccaggatactattgtcagcggcgcaaccactgacgacaatacaccggtcattcacggcactggcgacatcggcagcgtgatcacgctctataatggcagtagtgtcgtgggcgtagtcaccgtcgatgagaccggtacctggacgctgccggtgaccagcgcgttgccggatggcgtctacaccctgaccgccattgccgccgatgccgccggaaacagcagcggcgtatcgaacagctttaccttcaccgtcgacaccgttccgttgcagccgcccgtcgtcaatgagatcctcgacgatgttgcaccagtgaccgggccattaaccgatggcgcctttactaacgatcggacgctgactattaacggcagcggcgaaaacggcagcaccgtcacgatttacgacaatggcgtggcaatcgggacggcgctcgttaccgacggggtctggacattcaatacgtccgaattgtcagaagccagccatgcgctaaccttcagcgcgactgacgatgctggaaataccacggcgcaaacccaaccgatcaccattaccgtggatatcaccgccccgcccgcgccaacgatccagacggtggccgatgatggcacgcgcgtcgccggacttgccgatccttacgctaccgttgaaattcatcatgccgatggcaccctggtcggcagcgctgtcgctaatggcaccggtgaatttgtcgtcacgctcagtccggcgcaaaccgatggcggtacgctgacggcaattgctatcgatcgcgcggggaataacggcccggctacgaattttcctgcttccgacagcggtctgcccgccgtcccggccatcacggcgattgaagatgatgtcgggagcatacaggggaatattgcagcgggcggcgccacggacgacaccatgccgacgctgcgcggcaccacggatatcggctctaccgttgaagttttcattgatggcgattcggcaggctttgccaccgttgacgccagcgggaactggatctttgagatcgcgacgccattaagcgaaagcacacattacttcaccgtccaggcaaccaatgcgaatggcccgggcggcctgtccgcaccggtcgggatcactgtcgatcttagcgcgccggcacaaccggttattaccagcgcaacggatgatgtccccggcatgaccggtacgctggataacggcgcgctcaccaatgattcacgcccgacgctcaacggaacgggagaagcaggcgccacaatccgcattctggataacggcgtagaaatcggttccgctacggtagatcaaagcggcaactggcgcttcaccccgaacacgccgctggagagcaacgcacacatctttaccgccgtggcgaccgatcccgccggcaatagcggtcagctttcggatggttttacgctgaacattgacgcgcaggcaccagatgtgccggttatcacctccgtgattgacgataacaatcaaccgaccgtcccggtgttaccggggcaatccaccgacgatcggcagccaatactgaacggaactggcgaacctggcgcgacaatcaccatttttgataacggtacgccgcttggcacggctcaggtaggcgaaaacggtagctggaccttcccggtgccccgcaatttgtcagagggaagccataatctgacggttagcgctaccgatccggcgggcaataccagcgcggtctccgcgccgtggacgatcgtggtcgatattacgcctccggcgatcccggttctcacctccgttgtggatgaccagcccggtattaccggcaacctggttagcgggcagctaacgaacgatgcgacgcccaccctgaacgggcgcggagaggcaggcgcgacgattaatgtctatcttgacggtaatcccgcgtccatcggtaccacgacggtgaatagcgacggcacgtggagtttcacgccgcagacgccgcttgcaaacggtagccacacgttcacccttagcgccaccgatccggcgggtaatagcagcgcggtgtccagcggatttgtgctgacgattgacaccacaccgcccgccgcgccggttatcgccagcgtggcagataatacggcgccggtaacgggcatcgtccccaacggcggctcgacgaacgaaacccgaccaacactctcgggtaccggtgaggcgggtacaaccatctcgatttataatggcagcgcgctggtcggcacggcgcaagttcaggccaacggtagctggagctttacaccgtctacctcgctgggcgcgggcgtctggaacctgacggcgacagcaaccgatgcggcaggcaataccagcgccgcgtccgaaatacgctcgtttactattgataccacggctcccgccgcgcctgttattgatacggtctacgacggtacgggccccattaccggcaatctgagttcagggcagatcacagacgaggcgcgccctgtcattagcggcacccgtgaagccaacacaactattcgtctctacgataacggcacgctgctggctgaaattcccgccgacaatagcagtagctggcgctacacgcccgacgcctcgctggcgacgggcaaccatgtaattaccgtcattgccgttgatgccgcaggcaacgccagccccgtttcggacagcgttaatttcgtcgtcgataccacgccgccgctgacgccggtaatcacatcagtcagtgacgatcaggcgccaggcctcggcacgatcgcgaacggccaaaataccaacgatcctacgccaaccttcagcggcaccgcagaagccggcgccacgatcacgctctatgaaaatggtacggtcattggcacgacaacggctcagcctgacggcgcgtggagcgtctccacctcaacgttggcaagcggaacgcacgtcatcaccgccgtcgccaccgatgccgcaggaaacagcagcccgaacagtacggctttcaccctgacggtcgataccaccgcgccgcaaacgccaatcctgacgtccgtggtggatgacgtcgcgggcggggtcacaggaaatctcgctaatggtcagataaccaatgataaccgccccacgctgaacggcactgccgaagcgggcagcgtggtcagtatctatgatggcgacactctgcttggcgtcacctcggctaacgctagcggcgcatggagcttcacgccgacgacagggttaaacgacggcacgcgcacattaacagtgaccgccaccgacccagcaggcaacgttagcccggccaccagcggttttactatcgtggtcgatacccttgcgccaacggttccgcttataaccagcatcgttgatgatgtcccgaacaataccggcgccattggcaatggacaatcgaccaatgacacacagccgacgctcaacggtaccgcggaagccaacagcgcggtaagtatcttcgataatggcgcgctggtcgcgaccgtgaacgccaatgccagcggcaactggagctggacgccaaccgcctcgctcggccagggaagtcatgcctatagcgttagcgccgccgatgcggctggcaacgttagcgccgcttcgccatcgacaacgattatcgtggataccattgcgcccggcgcgcccggtaacctagtcatcaatgctaccggtaatcgggtgacgggcaccgcggaagcaggcagcacagtgacgattacctctgagactggtgtggtactgggaaccgccaccgccgacggtacgggcagcttcaccgccacactcacgcccgcgcagaccaatggtcagccgctactggcatttgcccaggataaagcaggcaacactggcattgccgccggatttaccgcgcccgatacgcgcgtgccggaagcgccgatcatcaccaacgtagtggatgatgtgggtatttataccggcgctatcgccaacggtccggtcactaatgacgcacaacccacattgaatggtaccgctcaggcgggcgccacggtgagcatttataacaacggggcgctgctcggcaccaccacggcgaacgccagcgggaactggagctttaccccgacaggcaatttgaccgaaggcagccacgccttcaccgctaccgcaactaacgccaacggtacaggcagcgtctccaccgccgcgacggtgattgtcgatacgctggcgcccggtacgccgtcaggtacgctcagcgccgatggcggttcactttccggacaggctgaggcaaacagcaccgtaaccgtaacgctggcggggggcgtgacgctcaccaccaccgccggcagcaacggcgcatggtctctcaccttgccgacaaaacaaattgaaggtcaactcattaacgtgacggccactgacgctgcgggtaacgcctccggcacgttaggcattaccgcgccgattctgccgctggcggcaagggataacataaccagtcttgatctgacctctaccgccgtcaccagcacgcaaaactattcggattacggcctgctgctggttggcgcgcttggcaatgtcgcctcggttttgggtaacgataccgctcaggttgagttcaccattgctgaaggtggtacgggcgacgtcaccatcgatgccgccgcaacgggaatcgtgctttcgctgctcagcactcaggagatagtggtacagcgctatgacaccagcctcggcacctggacgacgatcgtcaacaccgccgttggcgacttcgcgaatttgcttaccctgaccgggagcggcgttaccctgaacctgaacggactgggcgaaggccagtaccgggtactcacttataacaccagtctgctcgccaccgggtcatataccagcctggatgtcgatgtacaccagaccagcgcaggtattattagcgggccaaccatcagtaccggcaacgtcatggctgatgataccgcgccgacgggcaccacggtcaccgccatcaccaacgccaacggcgtcagtacgccggtcggcgcgggcggcgtggatatcctggggcaatacggcacgctgcacattaatcaggatggcagttacacctacacgctgactaagcccacggcgggatacggacataaagagagcttcacctacaccatcacccagaatggcgtcggtagcagcgccgcgcaactggttattaatttgggtcccgcgcctgtaccgggcagcgtgatagcgacagacaataacgcctcgctggtctttgatactcacgttagctacgtcaacaacggcccctcgacacaaagcggcgtcacggtattaagcgtcggacttggtaatgtactgaacgcgaatctgcttgatgatatgactaatccgatcatctttaacgttgaagaaggcgctacgcgaaccatgacgttacagggaaccgtcggcggcgtctcactggtttccacgttcgatctgtacgtttatcgcttcaacgatgccattcaacaatatgagcagttccgggtgcaaaagggctggattaacaccctgctgttagccggacagtcccagccgctgaccctgacgttgcctggcggcgaatacttgttcgtgctgaataccgccagcggcattagcgtcctcactggctatacgttggcgatttcccaggaccacacctatgccgttgacagtatcaccgccaacaccaccggcaacgtactgaccaatgatgtcgcccctacggacgccctcctcactgaagtaaacggcgtggcgattgcggcgaccggcacgacggaggtaaatgggctgtatggctcgctcatcattgacgcaagaggcaactatacctacacgctgaagaacggcgtcggcgccgacagcattaaaacgccggacagctttatctatacgctcaaagcgccaaacggcgataccgatacggcctcgctcaatatcacgccaaccgccagggcgctggatgcgattaatgatgtcagcgatacccttagcgtcgccacgcttcaggataccgctgcctggctggactccagcgtcggcagcgccagttgggggctactcggcaaatcgggcagcgggagcggcacctttgacgttgcaacgggcaccgtacttaaaggcgcgtcactggtctttgatgtctccacgctcattacgctgggcaatctgaatattagctgggccattcaggagaacggaaccgtcatacgcaacggaaccgtcccggtggcgaatatcacgctgggcagcgcgacggtgaccgtcaacctgagcggcctggagctggatgccggaacgtacacgcttaactttaccggcaccaataccctggccggggcggcgacaatcacgccacgcgtcatcggcaccaccgtcgatctggataattttgaaacgtccggaacgcataccgttctcggcaatatttttgacggcagcgacgcggcgggggcgatggatcagcttaatacggtgaatactcgcctgagcattagcgggtataacggcagcgccgccacgctggacgccgcggcgaataccaccagcgccacgattcagggacattacggcacattgcaaattaacctcgatggcgcttacacctacaccctgaataatggcgtcgcgatgtcgtccatcaccagtaaagaggtctttacctatcaactggatgacaagataggtcatacggatagcgccacattgaccattgatatggcgccgcaaatcgtcagtaccaaccaaaacgatgttcttatcggctccgcctatggcgatacgctgatttatcacctgttaaacggcgcggacgcgaccggcggcaacggcgccgatcgctggcaaaacttctccaccgcgcagggcgacaagatcgatatccacgaactgctgaccggctgggatcaccaggcggcgacgctaggtaactttgttcaggttcataccagcggcgccaatacggtgatatccgtcgatcgcgacggcgccggcagcgcgtttaaatcaactgaccttgtcactttggagaatgtgcagctcacgctaaatgatctgttgcagaacaaccacctgataaccggcggttgataaaaagccccgaacgccacgacgttcggggcaacaagcggtgatatttaaaagggataaactatgggaagagtcgcgcctgtcgccatcgtactggcatttgctttgtttcatcaccagccccggggcgcagaagcgctgccaatgattacatccgaaggattagcaacggaccagatgcttccttcgctggatggctccgccgctgagttgccgctcagcgccgccgcgccgggcaacctgacgctcaatgacgcggtcaatcgcgccgttaactggcatccttctattcgcgaagccgtcggcaaactgctcgcacagaatgaacaaatagaggtcgccaaatcgaaatattatccgcaagtcagcgctggcgtgaacaatgggtacagcaatacctacaccgatcacgggtatagcccctcgctggtgctgtcggtatcgcaaatgctttatgacttcggcaaagtggcaagccaggttcgcgccgaaaccgcaggcgcagcacagcaacaggccaacgtgttgctcagtattgataccgtcgcgcacgaaaccgccaacgccattgtacaaacgcagagctggcagcaaatggtagaagcggcggaagaacagctcgtcgcgctggacagcatcggtaaacttatccggcagcgcagcgatgaaggcgctacgtcgctatctgacgtggtgcaaaccgaagccagaatcgaatccgcccgctcgcaactggcgcagtatcaggccaatctcgacagtgcgaaagcctcactgatgagctggctgggctggaattcgcttaacggcatcaataatgacttcccggcgaaactcgctcgcagctgtgagacagcgacgcccgaagatcggctggtgcccgcggtactggccgcctgggcgcaggccaacgttgcgcgggcgaatctggactatgccagtgcgcaaatgacgccgacgatttcgctcgaaccttctgtacaacattatcttaatgacaaatatcccagtcatgaagtgctggataaaacccagtattccacctgggtgaaagttgagatgccgctttatcagggcggagggctgactgcccgacgcaacgccgccagccatgcggtagacgcggctcagtcgaccattcagcgcacccggcttgatgtccgccagaaactgatggaggcgcgcagccaggcaatgagtcttgccagcgcgttacaaatccttcgtcggcaacagcagcttagcgaacgcacgcgcgaactgtatcagcagcaataccttgacctcggttcccgcccgttgctcgacgtgcttaatgcggagcaggaggtttaccaggcgcgttttgccgaactgcaaacggaaagccagttgcatcagttacaactgaactatctgtataacaccggcgcgcttcgtcaggcgttcgcgttaaatcatcgcagcattcaatccgtggagatccagccatgacccgcgccgcccccgatgtagaagaggtactcagtgagcgcgcgctaagccaatgggcgcaggccatcagccatgtcgccggtcattatcgcgttgcctgttctcccggttcaattcaggccaacgccccgtggtttaggggtaaaagcagaacgaccgccttaacgcagctcgcgcggcaggcgggtttatcctttcatgcgccggacatagacaaaacggcatttagtcagtggcgattgccgttggttgtcgagctccgggacgggcagttattggtcatcgaacatgttaatggcgaagatgcggtagacgtttttgtgattgaagaagagggtcagcgtaaccgcctgacgctcagcgagttattgccggagatcctctatgttgccgcgctacgcccgctatcggcgctcaaggatagccgcgtcgaccgctatatctcccgctttaaacccgactggatgcgcgagctggttctgcaggatattcgcccttatttaccggtaatggtcgccgcctttctgattaacgtgctgtctctggccgggattgtgttctctatgcaggtttacgatcgggtgatccccgctcagtcatatcctaccctgtacgtgctctccttcggcgtgctggtagcggtgctgttcggttttctgctgcgtgaagcgcgtacgcacattatggacgtgctcggtaaacgcgccgatatgcgcatttccgatcgggtattcggtcatgcgttaaggctgcgcaacagcgctatcccccgttccaccggcagttttatctcgcagttacgtgaactggagcagatccgcgagatgattacctcttcaacgctggcgaccattgtcgatctgcctttctttttcctgtttatgatagtcttggcgattattgccccaccgctggcatggatagcgcccgtggcggctctgctgatgatcctgccgggcgtcgcactgcaaaaaaaactggctgtcctcgccaaccaggccgcccacgaagcgacgctacgcaatgcggtcttggtcgaaagcgttcaggggctggaagatattaaactgatgcaggcggagaaccgctttcttcagcagtggaatagctatatccgtattaccggcgagtcgggtctacgcacccgcaaactcacgcaaaggcttatcagttgggggatgtcggtacaaagtctggtgtatgccgcagtgattatgttcggcgcgccgatggtcattgaaggcagtatgactaccggcgccgtggtcgccgcgtcgatgctcggctcacggatgatcgcgccaatggctaacctgtgcggcgtgctggcgcgctggcagcaggtgaaagcggcgaagatgggtctcgacaacattatgcaactgcccactgagacacagcatgacgatagcctgatacaccgcgacatcctccacgggcattacctctttgaaaacgctcagtttcgttaccataacgacgatcaacgcataccgctgcgcctcgtgcgtctggagatcatgccaggcgagcggattgcgatactggggcgtaacggtgcgggtaaatccacacttttacaggcgatggcgggcggcctggagatgattcagggagatgcccggcttgataatctcagcttgtcgcacatcgatatggcggatttacgccgcaacatcggctttcttagccagaacgcgcggcttttcttcggcaccctacgagagaacctgacgctcggcgcgccgcacgccaacgatgaacagatttttgacgcgctcgaagtcagcggcggcgccgtcttcgtcaggcggctggcaaaagggttggatcatcccattatggagggtggtaacggcctgtccggcgggcagcgtcagtccctgttgctggcgagaatgctgctgcgctcccccaatattgtgctacttgacgaacccagcgcctcgctggacgagcatacggaacgagagtttattcagcggttacatcagtggcttggcaaccgtaccctggtcgtcgcaacgcaccgggtaccaatactggagctggttgagcgtgtcgttgtcctgaaagaaggacaactggtgatggacgcgccaaaagcgcaggcgcttaacgcggatcggatgcaaagtcaccgtcgggagtagaaaaatgaaaatcaatcagcatgatgccgcgatggacgatttcgatattcagcgtgaacgggcgttttccggcgcgggtcgtattgttctgatctgctcactgttatttctcattctcggcatctgggcgtggtttggccgactggatgaggtttccaccggcaacgggaaagtaatccccagttcacgcgaacaggttctgcagtcgctggatggcggcattctggcgcagttgacggtgcgggaaggcgacagagttcaggctaaccagattgtcgcccagcttgatccgacgcgtctggcgtccaatgttggtgaaagtgcggcaaaatatcgcgcttcactcgcctccagcgcacggttaaccgcggaagtcagcgacttacctctcgccttccccgctgagctgaacggctggccggatctgattgccgcagagacgcgtctctataaaagccgccgcgcgcagctggccgataccgaagccgagctacgggatgcgctggcgtcggttaataaagagctgaccattacccagcggctggagaaaagcggcgcggccagtcatgttgaagtgctacgcctgcaacgacaaaaaagcgatttaggcttaaaaattaccgatctgcgctcacaatattatgtgcaggcacgcgaagcgttatcaaaagcgaacgctgaggtcgatatgctctccgccattttaaaaggacgcgaggattccgtcacccgccttaccatacgttcgccggtacgcggcattgttaaaaatatccaggtcacgacgattggcggcgtgatcccgcctaacggtgagatgatggagatagtgccggtagacgatcgtctgttgattgaaacccgcctttcgccgcgtgatatcgcctttattcatcccggccaacgcgcattggttaaaattactgcttacgattacgccatttacggcgggcttgacggcgtggtggagaccatttcaccggataccattcaggataaagtgaaaccggaaattttctactatcgcgtgtttatccgcacccaccaggactatctacaaaataaatcaggacgccgtttttcgattgttccaggcatgatcgccacggtggatatcaaaaccggtgaaaaaaccattgtcgactatttaatcaaaccgtttaatcgcgcgaaagaagcgctgcgcgagcggtaaatcgctgaagataagaagatacgggggctggtcacgcgtgtcacaagtctgttatacttaccttacacattggggctgattctggattcgacgggatttgcgaaacccaaggtgcatgccgaggggcggttggcctcgtaaaaagccgcaaaaaaatagtcgcaaacgacgaaacctacgctttagcagcttaataacctgcttagagccctctctccctagcctccgctcttaggacggggatcaagagaggtcaaacccaaaagagatcgcgcggatgccctgcctggggttgaagcgttaaaacgaatcaggctagtctggtagtggcgtgtccgtccgcaggtgccaggcgaatgtaaagactgactaagcatgtagtaccgaggatgtaggaatttcggacgcgggttcaactcccgccagctccaccacttgctcttccggatacgtccggagaaatcctgaaagcccgcatggcacaagctctgcgggcttttttgtgtctactgttgtccgaggatatccagctaaatccagtgattattggtatacgtttaggtatacggtaggatgtatacctaaatgcgtataccaattcatgaaggagcggccaaattggcaagaacgacacgccccctgaccaacacagaagtactgcgcgctaaagcgttagaaaaggatctaacgttgcatgatggcgatggtctttttctactcgttaaaacgaacggtaagaagttatggcgtttccgttatcaacgtccggcaacaaagcagcggacaatgatggggctaggtaccttcccagctctttcacttgctgacgcccgacggttaagagcggattacctttccttgttagccaacggaattgacccgcaaattcaagctgaaattgcagaggaacagcagcaaatcgcacaggacagtatttttacaacggtcgccgctaactggttccagcttaaaagcaaaagcgtaacccctgattacgcaagagacatttggcgctcattggagaaagatgtattccctgccgttggtgaactcccagttcagcaaatcaaagcccgaacgttggttgaagcgcttgagccagtcaaagctcgtggggcgctagagactgtacgtcggctagtgcaacgcattaacgagataatgatctttgccgtaaatacagggctgatcgatgccaatccagcttccggggttggaatggcctttgagaagccaaaaaagcaaaacatgccaacactacgaccagaagaactaccaaatctaatgcgttctttagccatgtctaatttatctgtatcgactcgctgccttatcgaatggcagcttctaacacttgtacgcccttctgaagcctctggtactcaatgggcagagatcgatcttgagaataaactctggacgatccctgcaggacgaatgaaagccaagcgagaacatattgttcctctgtcggttcgagcattagatattttagagataatgaagcctattagtgcacatcgtgaatatgttttcccaagtagaaataatcctaagcaaccaatgaatagtcagacagctaatgctgcattaaaaagaattggttatggaggaaagcttgttgcacatggtttgcgttctatagccagtacagctatgaatgaggaaggttttaatcccgatgttattgaagcagcattagcgcatagcgataaaaatgaagtccgtaaagcatataatcgttcgacttacctttatcaacgaattgatttaatgaattggtgggctaacttcgtgtttaaaaaaacacacgaatagcccacataaaataagaggctgctcaatgcagccattatttcaatgaattaatatacgtatttaatcctgttgattttataactcccatcacttctggtgattttttcaaataaacaacattaggccatgacagataagcaataataatacatattagtcgaaccattgcaaaatcagacagattaatgagagtttcaatatacatatgtttatcttgctcatcgaaaccattttcagttataacttcattatcaacaagtttaactgcaagataaaaccttcttgcaaatgaaaacatcttatcatcagatttatcatctaatgattcaattattttaatcaaagcatcttcagcaatacctctttgaatactggttttaatcagttgctcaagtttatttacagcattaacctttttaacttcaaaatcaccacttggagatggaaaaatcaaagagaaatcatcaaaagcacttttttgcgcgttaattaaattataaaattgaaattcaaatgacttccttttatcaagaaactcctgtcttttagtctcattaattaaacattcattcgcagttaattgcattttaactgatttaattagaagtaatattgaaatgaaactcaatataggattaagaacacctccaaaataatcaccaaactgtccccatatctctttgttttcagaaagagtggttgagcttccaccaaattgataatagtataatccaaagactactaatatcaaaatagatgtaacccaacctatatacctcataccccatccacctcaataattaagtatttcactacctcaccattactgatggttaaatctctaacttttaataacaaatactctcgctcttcttctgccagtctattgttagcatctagattactcgttattttcttggtctgggcatcagtaacgtattttagaccattcaaaaaaccaaaagaagtcgttttttcttcccccctgactaacagtctaccatttccagtaaaagtattaaacctagtaactatagcttctatctgatgatcatgattagtttcaattagctcagttatattcaaagcggtatttttgtttaaagtaattatcttttgcttctcacccggctttctataattcaaatcaactgaatagttgcacatggtggaaattttatgcatatttttaagtctatttcgaatagctttagtcaactcatcttcaatatcgtctaatccggaaaccactttttttgcagcgtcactcaatgccggaccttctaaaaaaagagactcataaatataataactcataacttctgcaaatacagtgcgagtcatacttgaaagacgcgctgcaacttttctatctgatataacaacatcaaatcgctgaccaaaagatcctgtaaaagaatgcttaaggtttgttcttatttcattagattgatgtctgttttctttaactttacctcgaagtattgcctctgtaataatactggtaactccagatgcacccaatagtgtctggagagcataatccatatctatttcatcgtcgccgctattgataaccaaatcaagactaactttcattatttccccacgaattgataaaaatctgctcaatgcataaaagtccatatttttatacagtaatcaaacttccaatgtctaaaatatgcaaacacattaaactaaatttatgatagtgatcaacatattgcgcgcagtgctttccccgcctcgcccgccagctttgcagggcggttttaatgcagttgcacagtcacgctcaggccgcgccgggaatggcgcggtctgcagaaaatgaggcaggaaaacgcatgcaaagccatgcaccttatcgatgcatggcttttttcagtaataacgggcggattttcggggaattttacacagactgacgtgatgccagttgcgcacttttacgcgaaaaaatcatgttctgcgcaggagtgaatttttcacggctgtcatccaccgaagccgcgtcaggcctgaatccgatggtcgttaaaatgtcactatcctgtgcggaataattaattttttcccccttcgcaagccaggacagaagggcttcacgcagggcatctgtggcacgctgtatggcacagtttcgggcaatggccgtcagctcactgtatcccatcagctccggtgccagtgccgccgccagtgctgtgccgtgctgctgcataaaatcattcagccggtcgcggatgctgatgtgctgaacggcttcatgcgaacgaatataacgaccggcggcctgattcacctgccattttctgacttcgataatattgcgtaattcgtccaggcgactgacgtttctgccttctcctgacagaagccgcagatattcctgttcggccgcagccagctcatttttgcgttgcagccatgctgctttgttattctgacaggtgtcaaaggcctgctgtaaggctgtgctttccatcgttatctctttctcatcatgctgaagaataaaaatacggtgtgcggcgacggccggtgttaaccggcagccctcattccagacgcagcgaatatgattgtgtttttaaccgtactggcggcagttcctgtttttcatgcaggctttctgccagttcgtccggcgtgaccgggcggacaatgaagcgggtgatggtctgaagcgttttaaacaccagaccacagcccggatccgtgcacacataaaaacgctcggtgacttcctgagacagacgtcgcgatgttcttgacagtgcaaggcctttacatctccgacaacaatatccggtaacaagcattcttttcgggcgtttcatactgccggaggctgacgtcagtgaatcgcggtatctctgtttgcctgaaatgtattccattcctgaatctttacagtcagagaaaaagctttcactcgcttcaaatgtcgcagagcaataaatattccggcactgtgcaatcattatcttggtgccatcgtccatgaaatgtgcgcgacgggtgtgagcaacatgtccacacgacgggcagtaaatcatgacagcagtcctctggccttaagcactgctccctgctggtctattttgtcctgccacaccttgcgctgtgccggtgtgcctgccacctcataatccatgtgcgggagtgttgccgctgacagtccggtcagccggagaaccggctcgccggtgaggctgatttgcatctgtttaattttctgttccagcgatgatttcacctgctgcatgacagccttttccggtgcgacatagccctgatggccggtggtgttggcgagcggattttcctgtaccaggatgctcagatgcattgcccggacaagcgcctcacaggtttcattcagggcgtgttccagctcatgctctgcatacagactcagaagatgatgatgtgccttccggtaggtggtggccgtgctgtcacacgcccctttcaggcgttcacgttcaaaattcagcaccacggccagattgtcatattcctgtaccagctcccggcgtgccacgcgctcaatgtggcgctgtttcagctcgtcgctcaggacaccaccggctgcacgaaaggccgtgcgccagtcgtcagcatcgtttccgtcggcctgcgtcagcgcatttttttcctgctctgcccgttcaatggccgtgacggtctcatccatcaggcgggcgttctcaagatgagcgactctggccttttccagttgtgccagtgcgggttgcagatattcagggatggtgttgtcagacattttccggctcctcgtcacttcaggttaagaaaattgtgacgtacaccggacaacaacacgacgcattgcagatgtgccagccctgacacaggagactcatcctcagaccggcaagccaggaaaaggtcgcaggaaaaaccggcttactgtttgtttttttatattttactgttcacctctgttcaccataataaaaaagataagtaatacagtaagttaaagggtgaacaatcgcagtaatgactgttcaccgtctgttcaccactgttcacccgttgatgggctttttgtgctgtttattactttttatttttattaattcactgaaataaataagaaaaaacaatttgtatttcactataattttttccagctccttccagagcgttttaaagctatctggcgctgatgtacaaaaaatgcacagccattgtaaggctgccggaacaaatcccccctgttgcgtctgccaaaaatattcacaaaataaagcgctacccgaagccggacggacttatccggtgctgtatggacattaacgaggtagcccgatgcaagctgttttttcttccccgtctcccgcccctgtgacaccactgatgccgctgccggacatcacgcaggagcgttttttacgtctgccggaagtgatgcacctgtgcggcctgtcacgctcgaccatctacgaactcatccgtaagggggaatttccgccgcaggtgagtcttggcggtaaaaatgtggcctggctgcactctgaaatcaccgcatggatggccggacgcattgccggacgcaaacgggggtacgacgcatgatgatgcccgctctgcaaaaactccctttttctggcttgcctttttccggcatttgcggatatagtttttccgctgccgcaaaatcggcagccgggcgtgagaacccgagtatgttatcggcgacatatgacgcgccatgcgtctttttttgtgtcgcaatcaacgccacagagcgccagattatggtgtggcgtgtggtttgccgtgcaggtatgatcctgttcgcaatcgcatgttatgccactgagtcaatggtagctcaggcggggcagcctccgggctggccggtttccgataacgccggtattctcacccccgtctgggctatcgccatcgagcgtgagaactccggcgatagcgtcatttacgctgttatcggaggttgccttatggctacgacccttaccccctcacatcctgaatttgtctttgtgtttgcggctgtccgtcgcgcagaccgtcatccccgtatctgcatgcttcgcaccgtcgccggtgatgaacgcagcgcccgccgttcccttgtccgtgactatgtgctctcccttgctgcccgtctgccggtggtggaggtgtcccgtgcgtaataaaaaagcccctcagaccgtctcagcgcgtcatgacgcccgtgaacacctcagcattgaggcttaccataagctcaaccgcgccagcgccgtatcccagtttgttgggggtgatttgattcaccgtgaactctccggcctgcatcagctctacattccgcatattttcagctacctgaatgaagatattgattttgtgctgaatgagctgaaagccaaaggcctgtgccgcgattttctcgcccagcagaaagaccggggagacaggacgcatgtttgattttccccagcccggtgagatttaccgttctgccggttttcccgatgtggccgtggtcggcattctggaagacggtattccgtgggaaatgccgtaccgctgcccggacattgtctggaacccgtaccgccgtaaattcagtatccttgtgcgtatcctcgctgacgggcgcaccacagacatcccgctggggcgttttctgcgggaatttacctgtgaccgtcctgacctgtttaaacgcagccccgtaaaccggcatgcggtactgaaagaaatggccggagacccggaattacagaaatggcgggagaaatatctggatatttacccgcaggacactgttccggtcagccgggcagcaccggtggcgcgggaatggcgggaaattccccgcacggagcctgacccggaaaccaccccggataacagttaccgcaattatctgtaattaaaaaacgacacccgaaaaattaaatgtgcgtattcgcgcagggatacgcacgtcttcaggagacgcagatatgccttatcagttaatggaaccggcacggaatgcagtcatctgtcacagggaggaaagcaaatgaaaacacccttaccgcccgtcttacgcgctgccctttaccgtcgcgctgtcgcctgtgcctggctgaccgtgtgcgaacgtcagcaccgctacccgcatctcacccttgagtcactggaggcggccatcgccgctgagctggaaggcttttatctgcgccagcacggtgaggaaaaagggcgtcagatagcctgtgccctgctggaagatttaatggaatccggccccctgaaggccgcgccgtcgctgtcctttctcgggctggttgtgatggatgaactctgtgcccgtcacataaaagcgccggtactgcactgaaggagaacaacaccatgaaaatgaacgtaaccgccaccgtcagccatgcgctcggccactggccgcgtattctcccggcgctggggattcaggtgctgaagaaccgtcatcagccctgtccggtctgtggcgggagtgaccgtttccgttttgatgacagggaggggcgcggcacctggtactgcaatcagtgtggtgccggtgacggcctgaaactggttgaaaaggtgtttggtgtttccccgtccgacgcggccgcaaaggtggctgccgtgaccggcagtctgcccccggctgacccggcagtgacggccgccgccgttgctgaaacagaagccgcccggaagaacgccgccgcactggcacaaaccctgatggcgaaaacccgtcccggaaccggtaacgcctacctgacccgcaagggctttcccggccgggaatgccggatgctgaccggcacacacagagccggtggcgtgagctggcgcgccggtgaccttgtggtgccactgtatgacgacagcggcgaactggttaaccttcagttaatcagtgctgacggccgtaagcgcaccctgaaaggcggacaggtcaggggcacctgtcacatccttgaaggacagaatcaggccggaaaacgtctgtggatagcggagggatacgcgaccgcacttaccgtacatcacctgaccggtgaaacggtgatggtggcgctttcttccgtgaacctcctttctctggccagccttgcccggcagaagcaccccgcctgtcagattgtccttgccgcagaccgtgacctcagcggtgacggccagaaaaaagccgctgcagccgcagatgcgtgtgagggcgttgttgccctgccgccggtcttcggtgactggaatgatgccttcacgcagtacggcggggaggccacccgtaaggccatttacgatgccatccggccaccggctgaaagcccgttcgacaccatgagcgaagcagagttttccgccatgagtaccagcgaaaaggccatgcgtatctatgagcattacggcgaggcgctcgcggtcgatgccaacggccagcttctgtcccgttatgaaaatggtgtctggaaggtgctgccgccacaggactttgcccgggatgtggccgggctgtttcagcgtctgcgcgcgccgttctcctccgggaaggtggcctccgtggtggacaccctgaagctgattattccgcagcaggaagccccctcccgccgcctgattggctttcgtaacggcgtgctcgacacgcagaacggcacgttccacccgcacagtccgtcacactggatgcgcaccctgtgtgatgtggatttcaccccgccggtggaaggggaaacgctggaaacccacgcccccgcgttctggcgctggcttgaccgtgccgccggtggccgtgcggaaaaacgcgacgtgattctggccgcactgtttatggtgctggcaaaccgctacgactggcagctctttctggaggtgaccggtcccggcggcagcggcaaaagtatcatggccgaaatagccaccctgctggccggggaggataacgccacgtcggccaccattgagacgctggaatccccgcgtgaacgtgccgcgttaactggcttctcactgatacgcctgccggaccaggaaaaatggagcggcgacggtgccggactcaaggccatcaccggcggcgatgcggtgtccgtggacccgaaataccgggatgcgtactccacgcatatcccggcggtgattctggccgtgaacaataacccgatgcgcttcaccgaccgcagcggcggcgtgtcacgccggcgggtgattattcacttcccggaacagatagccccgcaggagcgcgacccgcagcttaaggacaaaatcacccgcgagctggcggtcatcgtgcgtcacctgatgcagaagttcagcgacccgatgctcgcccggtcactgcttcagtcccagcagaactcagacgaggcactgaacatcaaacgggatgccgacccgacgtttgattttatcggctatctggaaaccctgccgcagaccagcggcatgtatatggggaacgccagtatcatcccgcgtaattaccgtaaatacctctatcacgcctatctggcctacatggaggcaaacggctaccggaatgtactcagtctgaaaatgttcgggctggggctgccggtgatgctgaaggaatacggactgaattacgagaagcgccataccaaacaggggatacagaccaacctgacgctgaaagaggaaagctacggcgactggctgccaaaatgtgacgaccctgcaacaacctgaccctcatgactcatctgaccggcatctgccggtctttttttatcccgatatcccccgcaggtgaacaatccactgttcacccttcaccgtgtattcacccgttatcacactgaaattaaaagagaaaaacgaaaggtgaacagtgtgaacaatcaaatcaaaaaaaaacttttttctccctgtgtgatttcagtgcggatgattaatcaccggtatgagtcacaccggcagaatgccggaggtgaagaatcgaatgttcacccttcacccattattcaccacctatcactatgaaataaaaggagaaaatagaaaggtgaacagtgtgaacagttctttcgaaaaaaaattttttcctgtacgatatagcatcaatccaagtaaaaatgcgctttcatttcacattaacttacagccattggtatacgattaggtatacgcacaaaaactgaattaaacaaaatcattaaaaatcaaagcaatacaatatttattcaaactccgccagcccaccaaataaatcaaggggttacgtgaaagcgtagcccttttttctttggtagtggcggcaaaatggcggcaggcattcagtcaagcccagttgctactacatgcgatcgcaattacaacttaaagagtttcgcttgccctggattaacagcttcgacgtagtttttgacccctattctgtgcggctcataattgcttgaatagaaatcaatcaggaagtcactcattttctgagatgtgactttcataactcccttactcaaagttaaattaaacacgctaatctttgacgatggtgcctgagttttactcatgttggcttgataaccagatttacgcattgccactagtgcttcgtcgtaagccgcttgtaattgggccaaattgtttgacgagatgatcacatcatccataaacacacttagcttgagatcatgatgtttgttcaatcggcgtagtaagctaccaaaataacttttatctaagcagagggttgcaagtattggagattgaacaaaaccaaaagggaggacatgcttatgtggactatgggacaagtttcttacagttgaaaatgttgagatttcccgcgcttgagaataggtgaagtagctctttagatcacgggtgatacgactacggctcgttgactgaaaaaattgtttaatatcaacaacggcaaaaaaatcactttttaagtgtaatctggcagctttaagatgcccaccagttcttagatggtaaaaatagagtggcggaatccacttgtttctgacagcctgaagtatcttccctccgactttacgtgcctcaacgcttgggacataaacccaaaccccgggcttaatctcaaatttatcttcccacctttgaacttctattgtcatgagttaaattgttgtagttgaaggccatgttaagaacggcgtaaaccgcaccaactaagccaacaaacgcggttgcgcatttgagcatagcggtgatcagttcaacacgcgccttaactaagccaagttcgtttgtatccataacttgttcctccatagatacctgacgtctcttagcgcaagcgcatggccctaactaaataaaaaataacaaccagttagcccagaaagcttaacaagtcggcgtccgattacatggcaaccaggtaatcggtccgcagtcgcaaagcgacaaactacatatctacggagtggggataaatccccgctaacgtcaggcattgttaatttaacctcaacttatagaaaagtatagttttaaatcatgtagttatgtcgccatttaaatcggcaaacccacctgtttaaatttatgaggatgcggctgaaccggatttgactcttttggcgttgcaatcgaacgaacaaaagtttcatgggtaacaaaagtatggctgcagttaatgttctggcactggttgtaacgctctttggtcaatgaagatacctgaaaactgctgcgagtatgggcggcacttccacacagtgggcaaatcatcatttttcgagctctccccatttttgctaaattcacaataatgataccgcattattccattttgcaaacttaaaagttctccattgcgaagaatcattccatttcgaaatcatcaatcctcacttcaagctccagactggtcgtaaaaccattatccgggctgacagtatgtgtcagggtggtaatggtccattccgcatcatctatcggctgtttaaagccactgaccttcacaggcatttccgtgtagagatctgcccgaccttccgccagttgtagcgagaatgacgcaacgccgcgttgcaagcgttcccactgcattttcgccgctcgttcggcgttgctccggttggcataagtgcgattaagtaccagcacgttttcatccgtccccaccaggtaatcgccctgcttcgcttccggctctttcttctgcttcttagtcctgcgcttacgcttcaccgtggtgctttctttcttcgcgggttcgcgggtatgcaaccagctggcaattacgcccgtgtaggctccgcgatctgccagggtaaagcggtgactgtcgccgtccttccgtgtgatagtgatcaccggcagtggtttaccgctggcgcttttaccctgtccctgccggatgaataacagattgccatttttcaccgacgcaatagcaccgtactggcgcgccagccgcatcagaaaactgccgtcactctcattggtctggtctatatgctccacgggtttatccgacaggtcttcacccaatgccatcttcagtttgtgccgcgcagctatttccttcaccacttccccaacggtggtcttgtgccacgatttttcacggcgggtattcagggtttcacgaaaatcagcacttcgcgcccggatagtcaggcggtccggtgcgccagtgtgttcaatctcgtccaccgtgaatgctcctttcgggaaaagcggctgccccttccagcccaacgccagcgtaatgacagccccacggcgcggcagcacgatttttccgtcggcgtcgtccagctccaaatcaagctggtctgcttcaaagccccgattgtccgtcagcgtcagactcatcaggcggttatccagcacagtggtgatatccttcccctcaatactgatgctgaatgcgggagttttgttgcctttgttaagcagttcagagctgaaattcacgacagcagccctcccaccgttttactgatatcgcttaaggcagacgttaccgtatcctgcaaattattcagctgcgcactgagatcaccgaacatatcggacagggattcatccacccgtttgagcgacagggtgaactcaatccggcgcggcataccatcgcggaaaaactccgttttagtctgattcagtccctcaatcacatacatgccgtaaatcgtgccgctgccttcaatcaggggccatgcttttccctgttctgccatctgctccagagccagcaacgacagtctgccgcccgttatctccggcataagaacaccagaaagcgtcagcatgtcgttgtccggtcccagaaactgcgtggatggacgtcggttgacccggctgtttgccgcatgtcgccagctgcgttgatacagcagttcctgatacggcacagtgcgcagcataaacacgtacaatcccagcaccatcatcatgcgtcgtatcccccctgatcgctgtagttactcctggcttttgccttcagcctgcgttcacgttcatcaagctggcgggccacctcccgcgcaatatcctgcacactttgtcctggctgcgtctgaatgatgatctgcgtcggtgcctcaatccgttgaacgggcgacacagtggctgcgcgactcaccatcgcttcaccgcctttcgcgggaaatgccaaagggtgcaacggtggaagctctgctggcgcggcagcaacacccatcattccggcaacaacggcagccagtgcagctgtatttctccggctggtcacgtttgccgggccgttgacaatttcaggcccgttttcaccgacaatgccaaactgcccgcgcgggatatacccaccgctgtcatacatccccgcaaaaccatatccccatgatggaaaaccacctgatggcatcatcactttaccgtctgcattcaccgtcgcaggttgctgacgcgtcacgctttccggcagtttcgcctttgcagcctctttactgacaataccgagtttctccagcaaccaggaaacgccggatttcagggagtccagcggatgcatgaccatattcagcccttccgccagtgcctccccgaatcgtcgccccattgccgctgcgctctgcagttcggcagaggtcgacttaacgggcgtcagcagatcagtaaaccagccccacaacgcctgcactttgtcgccaatccactgaaacacaggcttaagtggttcgaatgctgcactgatgggacctgccgccgctttgaatccttccaccacgccaccgagaaatgcggtgatgggttgccagtatttccagacaaccagcgccacgcccgccagtgcagtaaccacaagacctatcggactgagcagagcacctaacagaccagatacggcatacagggcaatgcgcaacatcgccagcgggccggatgcgagcacacgcagcaccgcgcctgcggcagccagcccaccgcgtagtgctgccagtggattcataaacatcacagcaacagcacgtaaaccggataatccagaccgcaaaagtgcaaccggcgcacctgctacagttttcaggacattccccgtcagtgatgccgtgcggcgcaaagacgacaacggcgcagtaagtaaacccgcagcgttgcccgatgaagcaagcccgcgtcgcagcagtgccagtggtgcgccagccagccaggacaacgcgctgctagttcgggttactgctgccgtaacggaaggtaacgttttgatacccagcacagagaaccccagacggatgactgccagcggccccagcactgcagccagcgccaccgctaaggtgccgaggcccacggtaacggcagccaccacagcggctactttcatcagtgtgcccgtcagttccgggttagcttccacccaacgacgcgatgctcccgtgacgcttttcaccatgtacagaatatccatcagcggctggcgcagcgtttcgcccaggctgctgaaggtgttctgcgctccggttttgaccagcaaccactgcgcagaaagtgagtccttgttaatgtcggattctttctgcatggagccgagcgcatcattgcccgctgtcagttttagctggcgctgcagttccggcaggttgtttgccagtttcgccgcgtcatcgccaaactctttaccaaacaacatggtcatggcagacagacgcttgtcctgcggcagtgcgttcaccttctccagcacacgctggatagttcccatcgcatccttcgtcatctgcttttcaataacttcaggattgagtttcagcagattcatcccttcaaagaaactcttgctttgcatggtggcaatggacaattcacgcaccatcgcgtttgctgcactggctgcaacctccggcgcagcgcccagtgtcagaaaggtggaacccagcgccgccgctttacgataatccagacggtcagccacaccgcccagacgttgcatgacatcaataatgtctgcccctttcgacatggcgttatcatccagatagttcagcgcatcaccgagctgttcaatattgcgggtagggattttgtagagctgggcgattttccccagactttctgacagttcatccgctggcagctcaaaggctgttgccgcctttgctgccgtactggcgaaggccagcaggtcacgtttctggtcttcccagctgtcgtcagggtttgcgacgttcatgcgcgcaccaccttcaaccagtgcagcgaagtctaccgcaccgttttccatcggcaactgttcgctggcagccttgatggcatcctgcatttcataaaaacgtgcagtgcggttgccattatcgtcacgcagaccattgacctgctttgccacacctttcatggcatcttccatgctggtatagctttttactgccgccatcactggcgtccccattgccagccctgccgccgtggtggtggctccggctcctgcgatgcgatcgcgcacctccagcgaacgggcataactggcacgcgccacattcatcctgcgctgagcttcccccagtcgcttcagccgcgcctcctgtttcgacagttcctggttataacgtgatgtttcacgggctaaacgggcagttgctcccgcatcatctttcgcagaaattcccgcccggtacagttcagcacgcacaagcgccgtctgctgctgcagctttttctggcgttcttccaggcgctgaacagccagccgttgacggcccagagcaacaacctgacgttgcgaaggcggccccatcgctcccagttcctgactgagcaaatttgcacgctggcgggcatagttcagcctgtcgcctaatttctgattttctgcctgcagctttcggaagctgtccagactgctcccggcctgatcaagctgctttattgcatcgcgggattttttgacagcagcagccagttctcttgaactggcctgcgcagatcgaaatgggcgggtgagcttgtcaaccgcattaagaatgacctgcagacgcaggttgttatcactcatcgttggccccgcttctctgaatcgctttataccgccattccagcacttcggtcagcggcataacgtcagtaacggatggcggccagtgaaaaatggtggcgatatctgccaccagatcgtcaaccgtcaggctgtcggtaaaccggcaagcaccgacttcttcaacaaaaaagtgacaacctcaaccgacatggcagtgagatctgccgggtccatctctgcaatttcctgtgcagtcagtgccgggctggagatgcgggggatcacggtcatcatcgcgttcacatccatatccataatggcctgcaggcgtgtaccgcgcagcgcaccggactgcggtttacgcagcacaatttcggtgatttccgtttttccgcgcttgatgggagtatccagttgaatggtcttttcagtcttcttatcgctcattttgctgtcctgtaaattgggttctggcgcggtatcccacgccgttcagatacatcagaggccgagggcgttacggtgcgcttccatcaggtccacaccgtccacaatttccaccatgttgatcaggtccacttcatagagcacctcaccattgatggtcagcttcgcgtagctgttggtactggtcactttggtggtgttgctttcgcccgtcttccactcgccggaatccacttctttgtgacgtccacgcaccacaagctccacggcctgcacttccccggtatcatcacgctgaatagagccggtaaagcgcagctggatgccatccaccgtggctttgcccatctgcttaaacagcagcagctcagtaccaccaatggaaaattccgtatccagtgcgccgtcatccagccccagatccacatccactgcacccggcattccgccgccgcgatacttctcatatttgcgggtaaatttcggcagcgtcagcgactcaacgatcccctgccagttgttcccgtcattaaacaggttcaggtgttttaatttgcgtggtaaagccatgttgtccccttacgcgctgacctggctggagaaattcaccaggtactgatcggtgatgcgctgacgcagcatcaggttttcaagtggcggcactggcgtgtagtcgtagtcgatggtgagttttccggctttcagcgtgtctttgtcgttcaccgactcatccagccagcaatcaccaccaatgagatagccctgactgaccaggctgcgcattttggcgcggataccctcgataatgtcgcgggccagcgacggattcagcggtttatccaccgcccacatgtgcgcttctgccatcgtgtccgtcagcacctgcgccgtgcgggtgtagttttcgaaggcaaagagcgggtcatcactcaggcagcgggaaccccagaagcggaaaccgtctttacgcacaagcgtggtgacgtcgttctggttcagcagtcccgcatcggttgccgggtcctgcagatcccagaacacatcagcagaaattccggtgacaccgttcacgcccacgttggacaggcttttgtgccatccggtctgctcgtcaattttggcgcgcagaccaagcgcacgggcggtggcatatgccgttgcttcggcattcagcacagtgtcccagccagtaaagtcaggccagatcagcatcccttcgcgctggctgaagttttcacggtaagtgatcgcctcctgtaccgtcttgcagccatacgctgacaggtaagcaaatccacacaggctttgcgccacgctcagcaactcagtagctaccgccttggtgtcgtggcctggcacgccgagaatgcgcggtttaacgccaaactgtgactgggcagataacagggctttcatgcctgtttttttaccttcagcggtcactgcgccgatgatattggtcgtggtttcttcttccgtttcaccctgcggcacacgcacaacaacggtcacgggttttgcctggtcagcgatggcatccagcgaacgggccagcgtgcctgactcacccgctttaccgctggcagtcagcacatcagtgatcagcacgggtttattaagaggaaacatttttgcatcggcatcatcgcccgtgcagaccatacccacgatggcggtgctcaccgtggtaatggatcgggtgccttcgttgacttcaacaacgcgcaccccgtggtggtaatcctgagccatagtggcgaacctcctgattggattaggcttcgccctatgttgaagtgattgtgtccgacaaacagctaagcgcagttgtaccgttattcacacaaaatgacggtatttgtccgcttgcaggaataatcaaaataatgctgattcagggagatttattgttcttatttgccggaaattttcgataaatgatagaaacgcctacatcaaaaatcagtgcaatacgctgtcttgattctccggcctcgagtaaacgcccaatctgtgcccactgttcgctggtcaacttaggacggcgtccacctactctgcctttagcacgagctgcagccagccctgccctggtacgttcaactatcagttcgcgttccatttcagccagggcacccatgacatgaaaaaagaaacggcccattggggtgctggtatcaatactgtcagtcaggcttcggaaattcacgccacgctggcgcagctcttctatcagcgtaacaagatgccgcatactgcgccccagtctgtccagcttccagacaaccagcgtgtctcctgccgatagtgtcctgagcagctttttcagccccggtctgtcggacttggtgccactgattttatcctcaaaaatccgctcacatcccgcgcagttcagtgcattgcgttgcaaatcggtgttctggtcatttgttgacacgcgtacatagccaataagcatgatcatccccctgaataaaaaccggagatgatgccagttagctgttacctctgcattttcataaacgttggttttcaagaaccaataaatcgtgtggctggtgcgctataaaaatcgcagagcggtgacgatagtccgcataaggagctgttcgttcgcaacattcgaacggtgacgttaaagccggtttcattggctaatgaagacgaaggggacaaaattactacagagttgataccacagagatagtccaggttcgcaggtgatacgggatttaacgccggaaagtctgcacagacacgatctgccgccggacaccattaaattgccccgcaacgtgttatcaatactactccctgcgtttcccgttaccttgctgtcggtacgtttaccgcattgtctgaaaggttatttgcgaagttatcattaataatccacgggcgtctggtatgcgaatccagttccccaatcctggcgttttgccttctcgaccatacgcgcgtaaataagcctgaaaccaaacttcaccgcttaacgctctcctcttccccgatttttacgcaaaaaatcatcacatgatcaagggtcgtatttattattgcatttttcaaatgatattggtaattattatcattctcattaacgacttattcgatttatgacgtggagagagaggatttctcatgcgtattctgtttgtcggtccaccactgtatggactgctataccctgtgctgtccctggcgcaagcgtttcgtgttaatggccatgaagtgctgattgcaagcggtggaaaatttgcacagaaagcagcagaagctgggttggtggtatttgacgctgcgcctggtttcgattcggaagcgggttatcgccgtcaggaggcattgcgaaaagaaaataacattggaacaaaaatggggaacttctcatttttcagcgaagagatgaccgacccgctggtcgcgttcgccggacagtggcggccagatctcatcgtctatcctccccttggggtcgttggaccactgattgccgctaagtatgacattccggtagtaatgcaaaccgtcggcttcggtcatacgccctggcacatcaaaggcgtgacgaaatcactttctaacgcctaccgccgccatggggtcagcgcgccaccaagagatctggcgtggatagacgtcacaccgcccagcatgagcatactgcaaaatgacggagagccggttatctccatgcaatacgtcccgtataacggcggcgccgtctgggaagaatggtgggaacgtacacctgatcgcaagcgtcttctggttagcctcggcaccgtcaaaccgatggtggatggcctggatctgatttcctgggtaatggattctgccagcgaagtagatgccgaaatcattctgcatcttccggcaaacgcccgctcggatttacgttctctgccgccgaatgtccgtctggtcgactggcttccgatgggcattttccttaacggcgccgacggttttatccaccatggcggcgcaggcaacactctgacggcgctgcatgccggcattccgcagatagtctttggccagggtgccgacagacctgtcaatgcccgcgccgtggtcgagcgcggatgcggcattattcccggtaagagcggacttacgagcagcatgatcaatacctttctcggtaatcgcgcgcttcgcgagacgtcgcaggaagtcgcggcggaaatggcggcccagccttgcccgaccgaggtggcaaaaaaactgatcgccatgctgcaacacggctaaccgcggcagcgcaatgacaatatggcggctgagcccagactgtgtcgccataactcatctttcaccgataaggaggcttaatgcccgcgactcattcccccatgcccgctcgtgcctggatagttcgccttgcccgcgtgtgttgggaacgtaaaacactgagcatcattgtcatcgtagcatcagtatcgaccattttactggctgcgctgacgccgctaataacgcgtcaggccgtcaatgacgcgatagcaggcgatacgacccgcctgccgttacttgcctgcggcctgctgttaattgccctttttgattttatcgggaattacgtgcgccgcggctatgccggagaactctcgttgtgggttcagcatacgttacgtagccgtgcgttcgacagtattcaaaaactggacggcgcaggccaggacgccttgcgtaccgggcaggtcatttcgcgtaccaacagcgatcttcaacaggtacacaccttgctacagatgtgtccggtgccgctggcggtgctcacttactatgtggccggtatcgcggtgatgctatggatgtcgccatccatgacgcttatcgtgatttgcgtactggccgcccttgctattaccgccctgcgcgcccgtcgccgtgttttcgcgcaaacggggcttgcctcagaccggctggcgcacatgacggaacatatgcgcgaagtattggaacagatctcagtggtgaagtcctgcgtggcggagttacgcgaaacgcgttggctcgatggtcagtcgcggcagatggtgcgggtacggatcggtgccgctatctcgcaggcgatgccgggcgcaaccatgctggcgctaccggtgatagggcagatcgtcctgctgtgctatggcggctggtcggtgatgaacgggcgcatcgatctgggaaccttcgtagcgttcgcgagttttctcgctatgttgaccggccctacccgcgtactggcatcgtttttggttatcgcacagcgcacacaggcgtcggtagagcgcgtcttcgcgcttatcgacacgcgttctcgcatggaagacggtactgagtcggttgagggtcagattatcgggctggacgtggagaagatgagtttccactacgacaacggtaaccgtatcctcaatgagatctcgttttccattcacgccggtgaaaccgtggcggtggttggcgcatccggctccgggaaatcaacattgctgatgttgctggcgcgcttttacgatcccacctccggcggagtatggctcaacaccactacgggtcaacagaatattcgcgacctgaaactgacggcgcttcgtcgtcgcgttggcgtagtttttgaagacgcgtttctgtttgccggtacggtggcggaaaacatcgcctatgggcacccgcaagcgactcaggacgacattcgacgcgccgccgatgccgcaggcgccagcgggttcatcaatgcgctaccgcaggggttcaacacccgactgaccgaacgcggaagcaacctctccggcggccaacgccagcgtattgcgctagcccgggcactgattaccgcgccggaactgctgattctcgatgacaccacctcggcggtcgatgccggtactgaagcggaaattaacacggctcttggtcgttatgccgataatgagcatatgctgctggtgattgcacgccgccgttcaacactgcagttagccgatcggatcgtcgtgctggataaaggccgcgtcgtggatatcggtacccaggcggagctggatgcaaggtgtccgacgtttcgctcgctgatgagcggcgagggggattttctcgcccttgccccggcagaacaacgtacgctatggccaacaacgcaggcggtaaaatccgacgacgcgcatgagcgccagacaaccgccggaaaaggttttgtcgaccggatgacgcgcgttccggaacgcgccgtacagatggcgctggcaggccacgggagtcaagtctcatcgctgctgacgccagtagcctggatgttcgtcatcgccgccctgcttatcgcgcttgattccgccgcaggcgttggcgtgctggtgcttttgcagcgcggtattgactcaggcgttgccgcaggggatatgtcgactattggcatatgcgccctgctcgcgctgtgcctggtggcgatcggttggtgctgctatgcgctgcaaacgatcttcgccgcccgcgcggcagagtcggtacagcatacggtacgcttacgcagcttcagccacctgctacgcctgagtcttccctggcacgagaagcacatcgactcgcgtcttactcgcatgaccgtcgacgttgattcactcgcccgatttctgcaaaacggtcttgccagcgcggccaccagcatcgtgacgatggtcgctatcgccgcggcaatgttctggcttgaccccattcttgcgttaacggcattaagcgccgtacctgtagtgatactggcgacgtggatttaccgccgtttgagctcgcctgcttacgcccaggcacggctggaaattggtaaggtgaacagtacgcttcaggaaaaggtctccggtatgcgggtagtgcagtcacacggtcaacagaagcaggaagccgccaggctacgggcgttatcagacaacttccgcgccacccgcgtgcgggcgcaaaaataccttgctgtctattttccgttcctgaccttctgcaccgaggctgcctatgccgccgtgcttttaatcggagcgacccgggtcgccgaaggcgaaatgacgcccgggatactggcggcgttcttcctgctattgggacaattttatggcccggtacagcagttgtcaggcattgttgattcctggcagcaggcgaccgccagcggcaaacatatcaatgcgctattggcgactgaggaaacggagaatattgaaccgtcctccataacgcctggcactggcggcgcgctacgtctggaggcattgacattccgctatcccgaaaaaacgcaacctgtgcttgataatctctcgctcaccattccgccaggaacggtagtcgcggtggtcggacgtagcggcgccggcaaatcgacgctgatcaagctgctggccgggctctactctcccggcagcgggcaaatccgtgtcggtgagcgcctaattgatgccgcgtcgcttagtgattatcgtcgccagacggggctggtcacccaggatgtcgcattatttagcggcgatattgccgaaaatatccgctattcgcggccagacagcagcgacacggaggtggagatcgcggcgcgacaggcgggactctttgaaactgtgcaacatctgccgctggggtttcgtactccggtcaataacggcggcacggatctgtccgcgggccagcgtcagttgattgccctcgcgcgcgcccaactggcacaggcgcacattctgctgctcgacgaggcgacagcacgtatcgaccgcagcgccgaggagcgcttaataacctcgcttaccggagtgacgcataccgagaaacgcatcgcgcttatcgtcgcgcaccgactgaccaccgctcgccgctgcgatgttattgtcgtaatcgataaaggatgtatcgctgaatatggcagccatgagcagttgatagcggctcatggcctgtatgctcgtctgtggcgggccagcgtcggccagacacgcgatacgcaaggagaggtcgtaggatagtttttatcgccacgatttacgcaaaagaaagcccgcaagcggctgttcctgtaacagccgctttagctattgatactgaccgaaatataaacgagatggaatacaaagaatgagactgagcccgcccgtcgctcctgtcgctatacagaccgctacgcgccttcgccgtcaactcgccgccggaagccaggttgacgcttctcacttctggcgagaagcaaactcgctcgcgctgccgctggtgacagccattaacggcgcagacgatgaacgggaagtcaccttcctgtggcgtgccgcctctcctctgcggggggtttatgttcgcctgaaccgtgtcaccgataaagataacgtggcgaaaggtatgatgacgcaactgcccacaacggatatctggcatctgacgcttcgcttaccggcgtcctactgcggttcctatacgatggtcgaaataccaccgaaaaccccggacgagacggtgttgcagcttggaagccgtttcgcctcccttgtcgggaaggcggacccactgaacagcacgccgggaataaatgttcggggcaatgcgcaggagtccgttctggcgttggatcatgccccggcacaggaggagtggtcaggctgtcgcgcttacgccgggcagcttttcacctcagaacatcggctcgccggacaacgtcgccgtgtgcggctgtatcttcctgacgttcctgtcgaacaaccgctgggcttgctggtactcacggatggcgagatctggttcgaccatcttggggtaagcgccgccattgacgccgccatccgcagcggacgcatcgcgccggtggccgtactcggcgttgataatatcaatgcgcgtgaacgcgtcgcaatcctcggcggtcgccgcgagctggtgctcgacattgccgaacgcctgctgccaacccttcgcgccaaatacccggaacgacagtgggcggaccgtacacaaacggtgctggcagggcaaagcctcggcggcgtgaccgcgctgatggcggcccgccacgcgccagagagcttcggcctggtgctgagccactccccctcaatgtggtggacgccggacaaccgcaatcgcccgccccatttcagcgcagaagagcgctcatgggtcagcgaacatgtgttatccgcgccctcgccagccgtacgtacgcatctgtgcgtgggatcgctggaaggttcgacggtcccgcaggtcaaacagttgcatgaaaaattgcgcgccgccggtgttgaaagccattgctgcgtgtacaccggcggtcacgattatgcctggtggcgcggcgcgctgattgacggattacgtctactgccccgataaaacttcacctgccaaaaaggaataacatccgatgtatggtcgccagtaccacaacaagtgctatcgcgtggcgctatttttagtgagtttttgttttagcgcgctgagttatgcgcagccggatatgcagccattagggccgaatatggctgataaaggttcgggatattaccattttagggtcaatgactttcaatctgccgatggcgcaagacattaccgggtatggaccgctattcccaataaagccgccccgccgtcgggttatcctgtcttatatatgctggacggcaacgcagtgatggacaggctgccggagacgctgctcaaacaactggcagaccactcgccgccggtgattgtggcgattggctatcagactaacctgccgtttgatcttaacggcagagcttatgactatacgccggcgccgggaatcgatcgcgatgacagtgaaaataacccgcgttttcatcgtaagaccggcggcgggccagcgttccgccagctactggagagacatatcgcgccgcaggtggaacaaggaataaccatcaaccccgaacggcgcgggatatggggacattcttatggcggcctgttcgttttggactcctggctgtcgtcatccttctttcatatctattacagcgccagcccgtcactcagcagggataactttgccctgttgaatcgccttacggcagtgaagccgtcgccgttctgccataaaaaactcatcataatggaaggttcagcgtcgaatggggatagcaggcaacgccagatggccgagctcctgcaaaaagttcaggagaccgtgagaacgcttgagaacaacggcgttaacgcggccctgcagcattacccgggcctgggccacgggcccatgtttaacgcctcttttcgtagtgcattgctgggtatcagtcgcgaaccggcaagctaagaaccacgctgccattaacccgtcgccagaatatgcccgccagcggcgggcataacccatcaaaacgaggccgtcacaccggcataataagcccgacccggttcgttataggtatttgccccttcggcggagcgatagatctgtttatcgaagatattgctgataccgacattaagacgcaggttcttattgatatcgtagttaacgttagcgccgaccagtgagtaagcccccagcgctttcccggacaatcctttggtctcttcactacgcgactccgcatgtgttcgcggtttttgcttgccgtataacgtccagttgacgttagcggagagcgcgttggtgatagtccagtcgaggaaggtattcaccgtatatttcgggattatcgataagggattaccggtatctttttgctcagaagtgatcatataagtcgcattggtattccagttcagacggtccggcatcagcggaacagccatgctggcttcaataccttcaatcagcgctttaccgccgttctgccactgcaatacataagcgccagatgcgcttctgccaataatctgatcacctgcgacaatcttattctgataatcgttacggaaatacgttacgcttgcgtgataatcgtctacggtaaattccagcccaatctctttattgatactaatttcaggatcgaggttcttattaccaaccaggtaacagccgcccgacgtaatatcttttggacaaccgttgcctttcgaatagagtaaatacccctcactggtttgatacaagttcggtgccttaaaggcccgggcaataccggctttcaccttgacgaattcacctaactcctgggaaaggttaagactgggactaaaattactcccggattcgctcaaatagtcaaaacgcagacccggaataatattggtaccggccatgggttcgatattatcttcaacgtacagcgcactgatttccgatttatttttactgctacggttagccgccgaaccgggaatcccggcgatattgctatccttaaccgtcagactggtagaggaaggatcgttcagctcatcgcggttccactccgcgccgacggtgagcgtttgctcaaatagccatatcaccgggacattcacctcgccgctggtgcgatacgaggtcaggcggttagtggtgaacgtctggtcgttggtaatacgcccctcgccgccgccggagagtccctcattcatgcgggtattatcggttttttcatagtagaaccccaggcggctttgcccccagccccagatgccgttatgagttagaccgtaattctgccggtacaggcgattggtctcccgcccggactgcgccagacttttggtaaccgcgtttgaattactgttttgcgtatcgccggcatagatattcccctgccgactgtatcccgcttcaaaatcaaggatttgctgcggggtcattttccatgagaagacgctattaatatctttattggtgaccccctcccgtccggcggcatttttggtaccggcggaggagttaatatcccagctgtcggcatcggttctgttgagattaccgtacaggcgcatcgtcaacgtatcaccagccaacgggccgctaaggctaaagttaccccgccgggtgtcaccttctttgctgctttccgggtagttggtataaagcgacagcgagccatgccagtcgttagtggggcgtttggtgatgatgttcaccaccccgcctgcggcaccggagccatagcgcgcggcggcgggcccacggatcatttcaatacgttctaccatctccggcggcacccagttcgtatcgccacgggtgtcgcgttctccgcgccagctatagcgaaccgaatttcgcgacgtcaccggcacgccgtcaatcagcactaaggtattttccggccccataccacgaatatcaatttgtcggttatttccgcgcgtccccgaggcgctattgctggtaagattaaccccaggcatcttacgaataatatcggcaagatcgttaacgggaggattcttctgaatatcgtcacgagtaataatcgaaacgcccggctgttgctttaatacttgctcggcagtggattcaaccactatcgtttcgccgttgtcgtctgtagattctgctgctgataatggactattaatccctgtagaaaccacggttattaaccagatgaacttcttaactctcatacccattccctaaataatgtctaaagtagcgctgttgccctcaagctcacatccttgccaggttacggctatatagtaattattatcatatgctaatgataataattatcattcaattaagaaaaaggcaatctttcgaccgcaaaatctggtcataagaaaacagaaacgggattttgcaatatgactctctgtccgggctccgctttgccaataaatccgggaagggtggcagaatgcgcctactgagcggaggttttacaaaacaggaatagataaaataaaactatttttcaaagcgttaatgataataaacacccaggtaagatggtatagtgcggttcagagttcaccggcgcttccctgtcgacggcaaaccgttcttacagtttgccgtcagggtaatggcgggatcggatacgattgtagtcattcgatatatgacaatgaaagtgatgttggcgccaaaatacaaagcgcctggtaataattatcaggcgctttgcagacagaaaaccatcaaacatcggtttctcgttctccaggatctactggaaaatatggcaacccacagttagtggattttactgtcgggtcttgccagggatgttgtgttacccccaggtcttttaaaagacctcgtaacagcactaactcgctgggtgtcattttttgctttggttcaccctctttaggtggacgaatatcctcctgactagtacatgtaacacaataaccttttaactctatccacttaggcttaggggggggccttaggatcgggaggcgtcgggctggcaacgcacgaacaggcacttatacatccaggcataacgttttccttttcaaacaattcgctttagttggaagttctacttgagaaaatagaaatggttattcagatatttttaccggcgcatactcctgtaataataaaagatactgtaaataattaactctcagctactattcagtagcagattgttattcttacattgcttttatttcagatttacgtcaaatagggctaaatattttcactataaaatacgttaaaaagtgtttgtgtacttgtagacattgtggcgtcttcggtacgcaaatcggttagtgtacaatctttaaaactggtatttcttaaattagcctcagacaaatcagccccgtccaggttcgtagcagtaaaactagccttttgcaggtttgcccgagttaagacagcgccttccataatagcagccattatagtagcaccctttaatgtcgcaccgctcatatcggcacgtataagggttgagcctgaaacattagcgtgatccatattcgcaccggaacaattacattctaccatgctacagcctaacagacttgtgtgttgtaaattggcgccagtaagattagcgcgatcgagggtagcgccacacataatactatcttccagacaggcgttcgttaagttactgtcgcctaatgatgctcccgatagatttgcgcccttaaaatttgcaccgtcacaatccgccataaacagtattgccccctctaaatctgcgccgcttaagtctgcgtcacataaattttctgccgtcagatttgctccggtaaggacagcgcctttaagattcatgcctccctgggcagttaatattacagaatcctgaggaagagaaaattcgcatctgaatagtaaagctcgacatattttttcaaaagaggcaagcggaatttctcttgtctcagaattgtcgcctttactgactcgtacaataacttgtccagcttcgttattctcaccaggaagattaaattcgacacgacacccatccacatcatccaggatgatgttttctggcaacggagcacctctgtcagacattgaacttttcaatgtttcagccatagtctctatcaattcctgatattgtgtttcatttctccgacgtatcccaccacaggtaaaaaagttaatgatatgttgcagaatggttttgggcgaggtagcttgccgcatagcagcagaagtccccgcgccaaaagcagatgtagccataccagccagactatcgagtgaacgctgcatatattttctcccagagagagcaacacagtacatgataaaatttatcattagatttgcatttagaaataaggtgaataccccctttgcgtctggttacataatcacgcatcacgacgcgttgctgtctgacttacacaataccagccaaataaatatattggcttatactcgtcatacttcaagttgcatgtgctgcggctgcgttccctcaccccagtcacttactttagtaagctcctggggattcgctcgcttgccgccttcctgcaactcgaattatttagagtataaacattatttaaaataataaacacggcattcgttttaatactacgttcaggactcatcccactcattagcagaaaatctattaaaaagcgcgttcaggcgttttattgctgccattgataaactgtttaacaacgtcgtctgtacaggccttcttcgttgcctttacgtttaactcaatcaggctaccgtctcggttataagtctatcgagtagtagggacgtagtatgacgatgcagcaaagtgatatggaaagatataatccattattaatgttaaaagaagtcatggcgcagacgccttatcgccataaacgctggggagagcgtaagtttcgctataaatttgtattacgttgccttattaaccccgtaacgacaattaaatacttcaatgaattatgccatctgtctcagcccagaacgctgattattcatcgtccactgttgccggcaaaaatccagcggccctatttgtataccggacttagcatacgttgccgggcaaaggctattctggaacactaccagttcgttcagtcctttccggaaagtaaaattaaaaagatccttctgtccgaggaacaaatcttactcgctcacctggaaggaaaaaacggtgctctggtagatatctactgcggtccctgtggctatgacagagaaggtgaactgacattaacgctgtgcttcaatgatacgccgttggcacgtttatcattttcctttatccgccatgaagggaagcaaatagcgctggttgccgggttacaggggcccagtaaacatatcggcccacaagtcatacgtaacgccaccaaagattgttacggtctctttcctaaacggatgctgtatgaagcatttgcgacattgatgcaggcctgtaatgtcgacgagatttacgcggtaagtgaaaacaaccatgtttatcgtcaactcaggtacttattccagaagaaaaaaacttttgtggccagctatagtgaattctgggagtcgctaaacggcgttaagaaaggtgccttatatcatctgccatcacaggtgatgcgtaaagcgcctgaaagtatccccagcaaaaaacgcgcagagtatcggaagcgctatcatattctggatacaataatacaagaggttaacagcctctcccggtagaactatttcatacgcggatgtgcagatcctgctaccgttcagcggatctctttgaaatctgtatcgctactggatggttaaatacagaatggcttgcgagtgaaaagcgcggcattaaaccgtcgctttcattcatgctatgatcaacatcttaatcttattcccttcaccataacgtcatcgattagcatgttaaccattaaatacaagctaaacatttgtcacatttttatttggttgagcaaaaaaataatacaaaatagaattttcagtaagctaagtcaggagttttagtgaaaatacaagaagttaagcgtatattaacccgctggcagccgtcttcctttaccctataccgggaggtgtttacgcaatacggcggtagtatcaatatgcacccagatattgtggattattttatgaagcgccataactggcattttaaattcttccactataaagaagatgataagattaaaggcgcctactttatctgtaatgatcagaatattggcatcctgacgcgcagaaccttcccgctatcttcagatgagatacttattccgatggcgccagatttacgctgcttcttgcccgatcgtactaaccgactttcggcgttgcatcagccacaaatacgcaatgccatatggaaactcgccagaaagaaacaaaattgtctggtcaaagaaacgttctcttctaagtttgaaaaaacacgccgtaatgaatatcagcggtttcttaaaaaaggcggaagtgtaaaaagcgttgctgattgttcttctgatgaactgactcatatttttatcgagttatttcggtctcgtttcggcaatacttcatcctgctatcccgctgataaccttgccaacttttttagtcaactgcatcaccttctgtttgggcatattctttatattgaagggataccctgtgcatttgatatcgtactgaaatctgaaagccagatgaacgtctactttgacgtatctaatggtgcaattaaaaatgaatgcaggccactcagtcccggcagcatactaatgtggctaaatattagccgtgccagacattactgccaggaaagacaaaaaaaattgcttttctccatcggcatactaaagcctgaatgggaatataagcgcatgtggtcgaccccctattttaccgggaaatcgatttgctaaaaagaaagcctggacgtaaatatgttttttacgcccaggtttttcataaaccctgataaaatgataaaaaacgaaaatttaatcagaatttaaaaaataagttaaccaccatataatcataatgacaattactcgaaattcacttacactatgctcggttttatggaattgattaacacggtatgttacagataacgtgctaaaaagcgtgcagcggttatacattttcatatgtgtgtgtcattaacctggcgtcaggaacagatgatgatgacaactaccattttatctcttctggcctggcataccgtcagtagattaaaggtgtagccttgctttatggcattacaaaaatgtgggtgaggtctatgctcaatgtatacgttatttgtaacaacgctcttgtgcataaacaatacgttattgccaacagcactgaacgggtacagtggttcttgctgacaacaggcttaaagatcgtcttaacacgggatacctgataactggattatattatgacacatgcagactggctgattcttgggtatacaactgttattattatttttggtattgtatgttatatcggattgcttaaattgataacgaaaggcaagcatgaaaaataacgcacttaccgggaagaatatactctcaggagataaaatgcttcggcaatgatatgacaccactgccgaaatgctatttttacagaaatcaatcaggtattgagggtgattttatcatagccgcgccagcgataattcaacaacgagagcagccagaatagcacaaaagcacccactacccagaagcccacattccccatatgatcgttaagcgtgctgacggtctgccaaaatgttccgcttaactgtaacgcatcatcaatcaaccccagcgcttcaagcccgccaatcgccagcgcgacaatgacggatgcggcggtaatggttatattataataaagcttacgtaatggatgcgagaaagcccaaccgtaagcgccgaccatgacaaagttatccagggaatctaccagcgccatcccggcggtaaacagcacaggaaaaatcatcattgaccagagagatagcccctggttagctgctgaagcggaaatgcccagcaacccaacctcggttgcggtatcaaatcccaagccaaacagaaaaccgacaaaatacatatgccaactggaagtgaccaaacgaaacgtacgctgaaatatacgcgtcatcagcccgccaggtatcgcctcgtcatgcgcccccactgactcgccgcgggtaaccgagcgaaattgccgccagacgttgaacaaaataaacaggttgagcagggccatcgccagcagaaaaaaagcggaaacagccgtaccaatcaacgaaccatattgatgcaaaacatcaatacgatcgcgaaatgccatcgacgtcacaacaatcgccagacatgccagaacgacaatggtcgaatgacccaatgaaaaaaacgcccccacgcctaaaggcgttttaccctgctgcatcagtttacgggtgacggtatcgatggctgcgatatgatcggcatcaaccgcatgacgcagcccaaagctatacgccagtatggctgcgcttagcatgactgcatggtgatgaaaaacacagaacgcccaaatctaggccaggatgttaaccccgacaagaaagacggttaatgctattccccgtcgtttagtatgattattcatgcccctgcacccactatagttttaattaacgctacggtttgtagggggaatgtatgatcatttgattaaaacgtcacacctcaagatgcgactttttgtaaacgtgctttaccgctgacacatttgtgcgcattactgcgggacaaggcttaaaaagcgtatccgaacgtataaccctcccaacgcttcgctacgggaaaaatggggatgagtacggtgcaagcgtgcgatatcattgaccaaagccagaccaatgcccgccccggccacatttcctacgttatcgagccggtggaacggctgtagcgccagatggatgtgttcattatcaatgccggggccgctatcttcgacaaccagcgtcacggcatcgccatcccgttcaagccgcgcggtgacaatgccttgctcaggcgtgtatttcagcgcattatccagcaagtttccgcacagctcgctaagcagtacctcatccccctcgatccacatcgcttcctgttcgccttcgtagcccaggtcgatatgtttactgcgcgcctgcgccaggcgggtaaagcagccgctctgtacgatatcgtacagattcaccggggaaaaacgcctctcgccctgctctttatgctttaccgcagaaagttgcaacaatctttccgtgagctgaatggtgctatccagcgttacgctcatcgcctgcagactttcgtaccagtgatgagggtgctggctggctaacgccaccgccgcctgcgtttttaacaccgccagcggcgtttttaactggtgagaagcatcggcgctaaagcgttcctgccgggaaaggatgccgcggagcctgtcaatgtagcgattaaacgccacgattaacaagcgtgtttccgaccacggcagcagttccggcagcggcgttaacagacccggttcgcggcgtaccattaatgacgaaagttgacgcatagggcgcaggatccggcgtaataaccagccaaccagcaccagggtcagcaacaccagcagcccctgtgagatccaggaagagaacagcagttggcccgccagataacgacgggactgcagcgtttctgcgacataaacctccgccatgccgataatgccgccttcgttgaccggctgtagcaaacgcgctacgcggatcgcctcgccgcgatactcggtatgatagaaccacgccagcgccggataaagccgggtacggggcgtagcgggcggcatggcaggcagatcgtcataaccggaaatgaccttcccggaagggtcgacgactttgtaatagagtcgatcattcatattaagctcgaagctatccagcaccacccagggcacgttaacttccagatggttattgcgcaccaccagccgttccgataccgttcgcgccgaggagagcaacgtacgatcataagcctgagtggcggcctgtagcgcattgacataactgttaaacgccgacagcccccatagcagaatcagcggcaaccccaggaacagtaagagttgcaggtacaacgattgcggcttaacccacttcatcgccgcgctccagcacataacccaggccgcgcagcgtcgtaattcgtacatcgcttccctgaagttttttacgcagtcgatgaatataaagttcgatgctttcagggcttacctcatcgttcaggctgaacacctgttcaaaaagctgctgacgcgagacaggccgcgttcgtcggtacatcaatacggttaagagcgcctgctcacgcggcgtcagcgctaacggctgtccctgtaacagaaaatacccttcatcatgaaagatcaattcacccagttgctgaacttcatgaaccagcccagcgctgcgtcggagcaaggcccgtaaacgggcatccagctcttccagttcaaagggtttcggcagatagtcatccgcgccgacgttgagaccttttacgcgatccgccaccgcgcttcgcgccgtgagcagcaaaacgggcaaggtctgaccgcgtttacgcagccgttgcaccacctccagtccatccattcccggcatattgatatccagcaccatcagcgcatacatttcactgtgcagaagatggtcagccgccaggccgtcaaatacgcagtccacggcaaagccgttttgcaccagcgctttctccagccagtgagccagctcacggttatcttccgccaataagagacgcatatcacatcctgtaaagtttctgccgcattgaaagggaattgaaaggttattgttttaacaatcacgcaaccgaactgctacatgtcggctcacataatcacaaaaatcttcttccgaacctgaaaaatccggacgtccggcgtgaggataaaaaatgaaaaaacaattacttcgtacccttactgcaagcattttattaatgagtacctctgttctggcacaggaggcgccgtcgcgaacggaatgtatcgcgccagccaaacctggcggcggttcgctgctcaacctgtcgcaggggaaatttggtcgctacggcgtggatgatgtgcgctggctggcaagcgtgggcactgattacggcatgatcgccgtgcgtgcggattccccgtggaagacgctgaaagatctgatgacggcgatggaaaaagatcccaacagcgtggtcatcggcgctggcgcctctattggcagccaggactggatgaagtcggcgttgctggcgcaaaaggcgaacgtcgatccgcacaagatgcgctacgttgcctttgagggcggcggcgagccggtgacggcattaatgggcaaccatgttcaggttgtctccggcgatctcagtgaaatggtgccttatctgggcggcgacaaaatccgcgtccttgccgtcttttcagaaaatcgtctgctgggccagcttgccaatgtccctaccgctaaagaacagggctacgacctagtgtggccgattattcgcggcttctatgtcgggcccaaagtcagcgatgccgattaccagtggtgggtggataccttcaagaagctccagcaaaccgacgagtttaaaaagcagcgcgatctgcgcggcctgtttgagttcgacatgaccggccagcagctcgatgactacgtgaaaaaacaggttactgattaccgtgaacaggcgaaagccttcggactcgcgaaataatcgcggaggcaatgatgagcgatcgtatctttgcgggtatctggctgttgctctgtatcgccgggctattcatcgcctggcagatccaaagcgaatacagctatgaacccgtcggcccccgcccttttccgctggggattatcggcctgatggcgctctgcgcgctggcgctgttattgcgccatcccgacacggtgagctggccgcgccgccatgttctgcaaaagctaattaccatgatcatcatcctgttgatgtatgcctggggattcgaatggctgggttttcccatcgccaccgcgcttctcaccatggttatcgggatgctgttcggcgccacgattccggcggcgggtatctccggcgcggtattaggcattctgctgtggtatgcctttgaccggctgcttgatgtcaccttacctctcggcgcctggctgagttaacggagcaacgatggatacctggatatgtctttctcagggctttgcggtggcaatgacgccggaaaacctggttatcgcgttgattggctgcttcgtgggcacgatcgtcggtctgctgccgggcctgggaccgatcaacggcgtggcaatcttactgccgctggcctttgcgttgcatctgcctgcggagtcggcgctaattctgctggcgacggtgtacattggctgtgagtatggcggcaggatctcctccatattgctcaacgtccccggcgatgcggcggcgatcatgacggcgctggacggttacccaatggcgcagcaagggaaaggcggcgtagcgctgtcgatttccgcagtcagctcatttttcggttcattaatcgctatcggcggcatcattctgttcgcccctttactggcgcaatggtcgctggccttcggtccggcggaatatttcgccttaatggtttttgctatcgcctgtcttggcagcatgatggcgcaaaacccgcttaaatcatttctggcagctctgatcggtcttggccttgcgaccgtcggcgtggacgccaacaccggggtttatcgctttacctttgacagcgttcatctttccgacggcgtacagtttatcgtcgtggtgatcggcctgttctcggtatcagaaatacttttaatgctggaacataccagcagcgggcaaacaatggtccgcaaaacgggtcgaatgttgttcaacctgaaagaaggcgcgcagtgtatcggcaccaccctgcgttcttcggtaatcggcttttttgtcggcgtattgcccggcgccggggcgaccattgccagcgccattacctatatgaccgagaaaaaactcagcggcaacagcgatagcttcggcaaaggggatattcgcggcgtcgcggcgccggaggcggcaaacaacgcctctgcctgcggctccttcatcccgatgctgacgctgggcgttcccggttccggcactacggcagtgatgatgggggcgctgacgctgtataacatcacgccaggcccggcgatgttcaccgaacagccggatatcgtctggggactcatcgctgcgctgctgattgcgaacgtgatgctgctgatcatgaatatcccgttgatcggtctgttcacccgtatgctcaccattccgctgtggttcctggtacccgccatcgctgccgtatcggcggtaggggtatatgcggtacacagccccaccttcgatctggtgctgatggtcgcgcttggcgtgttagggtacattttacgtaaaatgcacttccccatgtcgccgctgatcctgggatgcgtactgggggaaatgctggagcagaacctgcgtcgcgcactctccatcagtaacggcaatatggcgattttgtggcaaagcggcgttgccaaagccctgctgatcatggcgatcatagtcattgtcgtaccgccagtgttacgtctgatccgtaaacacagccgtaaaccgcaggttgacgccagttaattgactgctgaaatacgttgtacttgtccggcctacgcgctcatgtgccaggccgggcaaccccgccagcatcactctttccataactcgctcattttacaccccttcttgccgttgtcaggctcgtggcgccgttaacctcacctttcgcattgttaaatatttgttgtttttgatcacaataattaaacaaaagcggttatttcatacgcgttcctggaaaatgtcgatatttttaatttatggctacgaaatgagcatcgccatgtctccctgaccatctaccgagaggaatgattctgatgaatgcactgactgccgtaaaagcgaacacagatgatttagcccaacgccatactggtttcatccttgccccttcggcgcagtcgccgcgcctgctggcgttaacgtttacggcggataccacaagacaatttctccatcaggttgcgcagtggccggtgcaggcgctggaatacaaatctttcttacgtttcaaaatcggcaagatcctcgacgatctgtgcggcaatcagctacaaccgctgttgatcaaaacgctcctcaaccgtgcacaaggcgcgctgttgatcagcgccgaagggatcgatgatgtcgcacaggcagaagagatggtcaaactggcgacggcggtggcgcatcttattggtcgctccaactacgatgcgatgagcggccagtattacgcgcgtttcgtggtcaaaaacgtcgacaactccgacagttatctgcgccagccccaccgcgtaatggaactgcacaatgacggtacctatgttgaggaggtgaccgactacgtgctgatgatgaaaatcgacgaacaaaatatggaaggcggtaattcgctgctgctgcaccttgatgactgggaacatctggagtcgttttttacccatccgctggcgcgtcgcgtcatgcgctgggcggcgccgccaagcaagaatgttagccatgacgtctggcacccggtgtttgatgtcgaccaacaaggccgcccggtcatgcgttatatcgaccagttcgtccagccaaaagactttgaagaaggcgtctggctcagcgagctttcagacgcgctggaaaccagtcaaaacatcctctccgtgccggtaccggtcggcaaattcctgctgattaacaatctgttctggctacatggacgcgatcgttttacgccgcatcctgacttgcgtcgcgagctgatgcgccagcgcggttacttcgcctacgccgccagccattatcaaactcaccaataagcgccacggcgaaggaattacgcggatgtatgattttgtgattatcggcggcggcattatcggcatgtcgaccgccatgcaacttattgatgtctacccggatgcgcgcatcgcgttgctggaaaaagagtccgcgccagcctgccaccagaccgggcataacagcggcgtgatccatgccggggtgtactacacgcccggcagcctcaaagcgcggttttgtctggcgggcaatcaggcgaccaaaaccttttgcgatcaaaacaacatccgctacgacacctgcggcaaaatgttggtcgccacctcggagctggaaatggcgcggatgcgcgcgctatgggagcggacggcggccaacggcttagagcgcgagtggttaaacgcggcggagctgcgtgaacgcgaacccaatatcattggcctgggcgggatttttgtcccttccagcgggattgtcagctatcgcgatgtcgcgacggccatggcgaaccgctttcaggccaaaggcggcgagatcatctaccatgccgaggtcagcgcgctaacagaacatgccgctggcgttatcattcgcacttcgcaaggccgagaaatcgaaaccgctacgcttatcggctgtgcagggctgatggcggatcggctggtcaaaatgctgggcgtggagcccggttttattatctgccctttccgcggcgagtactttcgtctggccccgcgacacaaccggatcgttaaccatttgatctacccgatccccgatccggcaatgccgtttctcggcgtccaccttacccgcatgatcgacggcagcgtcacggtcgggccgaatgcggtgctggcgcttaaacgcgaaggctaccgtaagcgcgacgtttccttcaccgacaccctggagattttccgctccgccggcattcgccgcgtactgcaaaaccatctgctttccggactgggcgagatgaaaaactcgctgtgcaaaagcggctatttgcggcgagtacaaaagtattgccccagcctgaccgtcaacgatctccagccctggccggcaggcgtgcgggcgcaggcggtttcgccggacggcaaactgattgatgattttctgtttgtcacgacgccgcgttccattcacacctgtaacgcaccctccccggcggcgacatcagcgatacctatcggcgcgcatatcgtcagtaaagttcaggcgctacgcgcaagccagagcaaccccggacgtacgctgcgtgcggcacgcagcgtggacgcattacacgccgcatttacccgttaacccttcagacaggaagcaattatgcaacttaacgactctaccctgttccgccagcaggcctttatcgatggcgactggcgcgacgcgcgcggcggcgatgtcatccccgtgagcaaccccgccaacgggaaaccgcttggcaatgtgcccaaaatgggggcggaagagacgcgcgacgccatcaacgccgccaatcgcgccctgcccgcctggcgcgcgctcaccgccaaagagcgagccaatatcctgcgtcgctggttcaatctgatgatggaacatcaggacgatttggcgcgtctgatgacgctggaacagggcaaaccgctggcggaagcgaaaggcgaaattagctacgccgcctcgtttattgaatggttcgccgaagaggggaagcgtatctatggcgacacgattccaggtcatcagaccgataaacggctgctggtgattaaacagcccatcggcgtcaccgccgcgattaccccgtggaactttccctcggcaatgatcacccgtaaagccggccccgcgctggccgcaggctgcacaatggtactcaaacccgccagccagacgccgttttccgcgctggcgctggcggaactggcccagcgcgccggaattctcgcaggcgtatttaacgtcgttaccggttcggcaggcgatatcggcggcgagctgaccagcaacccgctggtacgcaaactgtcgtttaccggctcgacggagattggccgccagctaatggaacaatgcgccaaagacattaaaaaagtatcgctggagttgggcggcaatgcgccgtttatcgtctttgacgatgccgatctggataaagccgtcgagggcgcgctggcttcgaagtttcgcaacgccgggcagacctgtgtctgcgccaatagattgtatgttcaggacggcgtttacgatcgttttgcggaaaaactcaaccaggcggtaaataagctcgcggtcggcgacggcctgcaagccgacgtcgctatcgggccgctgattgatgaaaaagccgtggctaaagtccaggagcatatcgccgacgcgctggaaaaaggcgcccgcgtaattacgggcggtgaagcgcacaaattaggcggcaacttctttcaaccgaccattctggcggatgttcctgataacgcgaaagtcgccaaagaagagacattcgggccgctcgcgcctctgttccgcttcagcgacgaggcggatgtcatcaggcaggctaacgataccgagttcggcctggcagcctatttttatgcacgcgatttaagccgcgttttccgcgtcggcgaagcgctggaatacggcatcgtcggtattaataccggcattatctccaacgaagtcgcgcctttcggcggtattaaggcctccggattaggccgtgaaggttccaaatacggcatcgaagattatttagaaatcaaatatatgtgcatcggcctttaacaggagagtcgctaatgaataccaataacactttaatgcagcgctgtcataacgccgttcctcgcggcgtgggccagattcacccgattttcgccgagcgggcggaaaattgtcgggtctgggatgtcgaaggccgtgagtatctcgatttcgcgggcggcattgccgtcctgaacaccggtcatttacatccgggcattgtttcagcggtcgaagcgcagttgaagaaattgtcgcatacctgttttcaggtgctggcctatgaaccgtacctggcgctgtgcgaacgcatgaaccagaaggtaccgggcgatttcgccaaaaaaacgttgctggtcacgaccggttcagaagcagttgaaaacgcggtgaaaatcgcccgcgcggcgacaaaacgcagcggcgctatcgcgtttagcggcgcttaccacggtcgtacccactacacgctctctctgaccgggaaagtacacccgtactctgcgggtatgggattgatgccaggccatgtctaccgcgcgctttatccttgcccgctacacaacatcagcgacgacgacgcgatcgccagcattgaacgcatctttaaaaatgatgccgcgccggaagatatcgccgccattattattgagccggtacagggcgaaggcggattttacgccgcctctcccgcgtttatgcagcgactgcgcgcgctatgcgaccaacacggcattatgttgattgccgacgaagtgcaaagcggcgcgggccggaccggtacgctgttcgccatggaacagatgggcgttgcggcagatattaccacgtttgcgaaatcgatcgccggcggctttccgctggcaggcgttaccggccgggcagacgtgatggacgctatcgcgccgggcggtctgggcggcacctatgccggaaacccgattgcctgcgtcgccgcgctggcggtactggacattttcgagcaggaaaatctactgcaaaaggcgaatacgcttggcaaaacgctgcgcgatggcctgatggagatagcggaaacgcaccgtgagattggcgacgtgcgcggactgggcgccatgatcgccattgagttgttcgaaaatggcgaccccggcaaaccgaacgcgactctgaccgccgacattgtggcccgcgcccgcgagaaagggttaattctgctctcctgcggtccttactacaacatcttgcgcatcctcgttccactcactattgaggcctcgcagattcggcaaggcctggagattatcgcccagtgctttgatgaggcgaaacaagcgtaatgtccaataagcagcgtcggatggcgacgtaactgtcttatccggcctacaaaaaccgtttcgattgtaggccgaataagccaggcaccatccggtaaacgagcgcaataacaataaagaggttttaggatggggcaattgtcagaatcacatgcattagggggcgggctgaaatcacgccacgtcaccatgttatcgatcgccggcgtcatcggcgccagcctgtttgtcggttccagcgtggcgattgcggaggccggccctgcggtactgctggcctatctgttcgcaggacttttagtcgtcatgattatgcgaatgctggctgaaatggccgtcgccacaccggataccggttctttttccacctatgcggataaagcgatcggcccctgggccgggtataccatcggctggttatactggtggttttgggtgctggttattccgctggaggccaatattgccgccattattctgaattcatggataccgggtattccggtgtggctattttcattagtgattacgcttgccttaaccggaagcaatttattgagcgtcaaaaattacggtgaattcgaattctggctggcgctatctaaagtaattgccattctggcgtttatcgcgctgggcgcggcggcgattagcggtttttatccgtatgccgaggtaagcggtatttcccggctctgggatcacggcggttttatgcctaacggcttcggtgcggtgttaagcgccatgttgatcaccatgttctcttttatgggcgcggaaatcgtcactattgctgccgcggaatccgatacgccggataaacatatcgtacgcgccaccaattctgttatctggtgaatttccatcttttacctgtgttccatttttgtggtagtggcgctgatcccgtggaatatgccgggtctgaaaagcgtaggttcgtaccgttcggtactggagctgcttcatattccgcacgcaaaattcattatggactgcgtgattttattgtcggtgaccagttgtctgaactccgcattatataccgcctcccggatgctctattcccttagccgccgcggcgatgcgcctgcgataatgggaaaaactaaccgtagcaaaacgccctgggtggcggttctcctctctaccggcgcggcctttttaaccgttatcgtcaattattacgccccggcaaaagtgtttaaatttcttatcgacagttccggcgccatcgcgctgctggtctatctggtgattgcgatttcgcaattgcggatgcgtaaaattctgctggcgcagggcggagaaattaagttgaaaatgtggctttatccgtggctcacctggctggttatcggctttatctgctttgttctggtggtgatgctatttcgaccggcacagcaactagaagtcatttcaacggggctgttagggctgggcataataggtactgtccccattatgtctcgctggaaaaaactgataaggtggcaaaaagcccccctgcaaaacctacgttagttattcccggcgtcagccgggaagcttctcaggagtaaaagatgaccgccctttcccaaccgacggccatagatggctatcgctggcttaaaaatgacattattcgcggcacttatcagccggatgagaaactgcggatgagtttattaaccgcccgctatgcgctcggcgtagggccgctgcgcgaggcgctgtcacaactggtggcggaacggctggtcaccgtggtgaatcaaaaaggctatcgcgtggcatccatgtcagaggcggaactcctcgatatttttgacgcgcgcgccaatatggaagcgatgctggtgcgcctggcgattgaacgcggcgatgatgcgtgggaggcggagatcctggcgcgagcgcatatgctcagtaaactggaagccagcgatgccagtgaacatatgctcgatgaatgggatcagcgccaccaggcgtttcattccgccattgtcgccgggtgcggctcccactatctgctacagatgcgcgaacgcttatttgacctggcggcccgctaccgctttatttggttacgtgaaaccgttctgtccgtcgagatgctggaagataaacatatccagcatcacacgctaaccgaagcgatactggcgcgcgaggcggcacgcgccagcgaattaatgcgtcagcatttgctgacgccgattcccattattcgccaggcgatggcaggaaaaatgtagccaggcacggcctgatagccattattcttcaggaatacgcaacacttgtcccggatatattttttccgggcttttcagcatcggtttatttgcctcgaagattttattatacagattggcgttaccatacacttgctttgaaatagcgctcagggtgtcgcctgattttacggtataaaactgactttcagccgctggcgtcgtggttttaacctgatcgtcaacgctgctaatcccggcgatattccccacggcaaccagaattttttcttttgcctcctgactcagcccatcacccgtcactgtcgcttttccatcagcaatttgcacattcactttgtcagcgtcgggtattcccgttttatttaaatgttcctagacttttttcgcctgatcgtccttatcatgattagcggttaccgcgtcccagagtttttcacctgcatcttttacaaaattgaaaagtcccatattcacctcgcttgtcaaaaatacacacaaagaaaagtgtagcagagggaatgaggttatcctgataagcggcgcttatgcgccgccggtggccggtaattaatgacgcatctgaacccaaaatgcatggataagccccggaatatatccgagtaatgtcagcaggatattaaggataaatgcccaaccgaacccttttcctaaaagtacgccgagcggaggcaaaataatcgtaaatacaattctccagaaacccatatacactccatacaagcaaaattagtcattgtttaaaaagagattttatctctaagcatagtcagtttacctgagcctgccagtcgcgcgccgcgcttttaccctcctttacgctttttacgctggcatcaggttgacgtttattttagaattaactaaatttagaaaacacttaaataactatgacagagcttgaaaaacttcaggccagcgcagaacaggcagcggccctgctcaaagcgatgagccacccaaaaagattactgattttatgtatgctttgcggttcaccaaaaaccagcgcaggcgaactggcgcgcattaccgggctaagcccctccgcgacgtcgcagcatctggcgcggatgcgggaagaagggctgattgatagtcaacgcgatgcccagcgcattcactatttcattaaaaatgaggcggttaatacgcttatcgccacgttaaagaatctctattgtccataaggaggcacgatgtccattgggatagtttccccccgtgaggcgcaagcgctgatagcgcaaggcgcgaaactgattgatgtgcgcgacgccgatgaatatctgcgcgagcatattccacatgcgcaactggcgccgctttcccggcttgaacagggcgatttgcccgccaacctgcgagcggaacagattatttttcactgtcagtcaggtaaacgaaccagcagcaatgcagcaaaactacaggccattgccgcccctgctcaagtcagtttactggaaggcggtatcgacggatggaaagcggcaggattgcccgtcacagaagacaaatcgcaaccgttgccgctgatgcgtcaggtgcaaatcgccgccggcgggttgacgttgcttggggtgattctgggctatacggtccacggcggctttttcctcattagcggttttgtcggggccgggttaatgctggcaggcataaccggcttctgcggaatggcgcgactactggaaaaaatgccctggaatacccgtactcattaagcggtactttcaccgcgcgtcggtaagtgtgtagtagactgaaggcgggtttataccattgttcaacgggaggacgtgatgttcacaccaggcgatatcgtacagccccgaatggggggggccgaaactgaaagtgattgaagtcaacgaggatcatattgtcgcggtacaggtcggtaatgagccgggcgaaaaattgatcctcaaagcggcagatgtcaccccctattgcgaaaagggcgattttggcgtgtgctgatttatcaaaatgagcatggcgcaacgttccctgaatcccggttaatagagacaggaaacgcagcgccatctgttaaaggttatccgtgattagattaagaaatcatccagagatttccccgccgccagcgcctgggcaatcggtttaggcgtacgaccttgtccggtccaggttttttcttcgccattgaaatcagtaaaacgatattttgccggacgcggttggcgctttttagcagaacgcggcattgctgaatccatggcaaataactcttccgggttaataccgtctgctttcatcagctccagaaaggcattaattttctcctgcttctcggcaagctggcgttgctgcaattcttcttcttcgcgtctttctttagtgacaaccctgaatttttcgagcatttcttcaagaacatcaatggagaattcgcgagccatagcgcgcagcgtgcggatattatttaagttctgtaacatcaaattcatatcaataaaaaccttttaacgcagaaaacaaaaactattacaggcggtattgtatgcgattattgattatatttccagatcctaaagttcatacagatatacacagcataactcgattaattatattaatctgttaaccagaagattatattcattaccccctgtgtgtttcaggttattctgcctacggtatatctgtaggtttcccgttcggctgtttatagcgtattgcgtatctcagtaaccgcggtgaccctcacggtggctgaccttatacagaagtgaatatttcagcacaataatagattaatcattcaaaaattatcatcagagctttatgctaaaaatcaccctgtaatagctataattatgctgagaaaagcagagcgcgtgccgttagccgagaatacatcgcatctgacaacatttggaatgtggctgaaaatcgccagaaaaacaatgcattataatgtattgatttaaaagtaattaatgactaacaacaacgaaaatctcgccgcgagcaaaaaaacacacaatcacagagtattttatcgacaaaaagcctataaataaaaatattacgctagttgatagttattatatagggatatactctatgaaaagacaaaagcgctttataatttcactaccaactatcacctcattctgatcgatacgctacaaggagcattaacatgttctctccacagtcacgcttgcgtcatgccgtagcagacacgtttgcgatggttgttcactgttctgttgtgaacatgttgatcgagatattcctctccggaatgagctttgagcagtcgctttcttccaggctggtggcgatacctgtcaacattttgattgcatggccatacggcgtttaccgcgatctgattatgcgcgtcgcgcgtaaggcaagcccggcgggatgggccaaaaacctggcggatgtattggcttatgtcacctttcagtcacccgtttatattatcatcttgctgaccgtcggcgccggctggcatcagatagtggccgccgtgagttcaaacattgttgtttcaatgttaatgggcgcggtttatggctacttcctgaattattgtcgtcgcctgtttaaagtgagcagctatcatcaggctaaggcataagttaacgtcgcgactggctttgccagtcgcgcttttagtcgcttttttcgtcgccaaaaagcccattcagataacgttctaacgctattcgggagctaaagccgtggggaataccgtaatgttcgtgggtctcgccgcctaaatagagcggaaaattttggtagtgatcgcaggttttaatatccgaagccgggtcagccagtgatgagctacggtcttttaatctggggtgaatgatcagcgcggtacgccccatacgcgcctcgcggttaacataaacataattctcgccgcgtcgataaccatacgtcttattcgtcaccacatcgacggtaaaccctgccttttccagtacccgcgccacctcgtcaggtcgtaaatacatgttttatcctcattctcttttactgcgggcttaccttacccgatagcgcgttatcaacgctttcagaaaagtccagaaacgcatgatatcgccgtaacaagcctcagcaggtaaaaatatgaactacactgaaagctacatcgaaatcaatggaggatcatatgcttaacaaaccgaaccgaaacgacgtcgatgatggtgttcaggatattcagaatgatgtcaatcgattagccgacagtctggaagatgtccttaaatcctggggaagcgatgcgaaagacgaagccgaggctgcgcgacgtaaagcacaggcgttgctgaaagagacccgggcgcggatgcagggtcgtactcgcgtaaaacaagccgcctgtgatgcgatggggtgcgcggatacgtttgtgcgtgaaaaaccctggtgtagcgtaggaaccgccgcagcggtggggatttttatcggggcgctgcttagcctgcgtcgctaacgacgtgcgctgccggatggcgacatactttatggggcctgcatcattgccgcaggcccaggtcgcgccattcggcgaaacggttactgtatcgcctgtcgaagctgacatgctacctgtttcgccatgccagcggaagtaatattggtaaacgacagtaaaatgcccccctttcctgacgaaaccactcgccaacgacttagcgcctgtaccgccagtccggcctgattcgcttttgctaccagcgctttatcatcaccttcaacctcaataaccaattgaataccgcctttctgtaatgtcacgacaaatccctgttctgccagcgcctcttcaatccataaccgtcgctgagcataatgttgacgcatctttttcagatgccgccagaaatggccatcacggataaaatcagccagcgtgtgctgccataacaacggtacgctacagggcatcagcgacgcctgctggcggaaatgctcaatctgctttatcggcaccaccagccaggcggtacgtaatgccggaaagagcgacttactgaacgttccggcgtaaatcactcgctgcggggcatccagactcttgagcggcggaagcggtttaccgtgataacgaaattcgctgtcgtagtcatcttcaataatccaggcctgcacattcgccgcccatgccagaagttgccgtcggcgagttaacgacagcgccacccccaacggactttgatgggcgggcgtcaccaatgcaaagcgtccctgcgggcaatcccgcatccccgctgcgacattcagcccatcggcatcgaccggaatcggcgccagcgtaatcccctcctgcgttatcaccgggcgaattaacggaaagccgggatcttccacccacatgctgtctcccggcacagacaatgtacgcaggattagccgcatagaatccgcatatccggaggtaataaatacctgttccggcagacattcaatgctacgcgaaacccgcaggtaatcgactatcgcctagcgcaaaatcgcctcgccgcagacgtcgcctaatgccagatcgaagcgtgtctgcgtgcgcaaccgacgccccattactcgcgcccacttctcgcgtggaaagagatccagcgccggtaaccccatctgaaagggtttcggttccggactttctccggcaaaaacagcgggtatcggcggcgccgtctcaaaccgtagagcgttgctcacaaacgtgcctgcctggccacgtcgctccagccagccctgcgctaccagctcgccataggcattttccaccgtggcgcgagaaacgcccagttcctgcgcccacgtccgactggaaggcaaacgcgttccgggcgcgagttctccttgctcaatggccgtttttaactgacgagcgatgtactgatagcgcggcatatggtctgctttttctgtaaaaatatggctctcttttacagaccattatagtgctacagtgctcgtcatcaacacgaggagaaacataatgacgacgttacgccaaccctattatgaactgagcccggaggtttacagcgctctggtgcaggcgaaaaacgcgctggaaaagagcacgattgaccccactctgatggagctgatttacctgcgtgtttcgcaaataaatggttgtgcatttttcctggagatgcacagtaaagcgctgcgtaaggctggcgtgaatcaagctaaattagatgcgctggcaggatggcgggtaagccaccatttcaacgagcaagagtgcgcggcgttagcctgggcggaatcggtgacgcacattgctgaaacccacgccgaagataatgtttacctgccgctgctcgatcatttcagcgcgcgtgaaatcagcgatctgaccttcgctattggtttaatgaactgctttaaccgtctggcgatcggtatgcgaatgtgacgcattgttgccggatagcgctgatgtcagccaactctgttatgcgtgaacctgcaggccggatcgggcgttcacgccgccatccggcaaaaattagccatgccgcccctaccccgctgcgttcatcagcggcgttaaaatcaatcgaaaattcccatatcttgtatggttgaatcttaattcaactacatctagtatttcgtgtatcaacacacgacaatccgacgcgtttcatcgcgccgttttctcattttaaatggaaatacgaatcatgagcattactatttacactcgcaataactgtgttcagtgccacgccacaaagcgggcgatggaaagccgtggatttgaatttgagatggtgaacgtcgatctggtgccggatgcagcggatacgctccgggcgcaagggtttcgtcaattaccggtggtgatggcgggcgatttgagctggtctggcttccgtccggacatgattaaccgtctgcccccgacgccccacgcggcaaacgcatgagcgcgctcgtctacttctccagcagctctgaaaatacgcaccgttttatgcagcgtctggggctgcccgccacgcgtattccgctcaatgaacgggagcgaattcaggtagacgaaccgtacattctggttgtgccgtcatacggcggcggcgggatggccggtgcggtgccgcgacaggtgatccgctttttaaatgatgaacacaaccgggcgcgcattcgcggcgtcatcgcctccggtaaccgcaatttcggcgatgcctggggatgcgctggcgatgtgatagcacaaaaatgcggcgtcccctggctgtaccgctttgagctcatgggcacacaacgcgacatcgataacgtccgaaaaggagtaaatgaattttggcaacaatcaccccggagcgcgtaatgcaggaaaccatggattaccacgccctgaacgcgatgctgaatctttacgataaagcaggccatattcagttcgacaaggaccagcaggcgatcgacgccttctttgccgcccacgtccgcccgcattccgtgaagtttgccagccagcatgaacgtctggagacgctggttcgggaagggtattacgatgacgccgtcctcgcgcgttacgaccgcgccttcgtcttccgcctgttcgagcacgcccacgccagcggctttcgcttccagacgtttcttggcgcctggaagttctataccagttacacgctgaaaaccttcgacggcaaacgttatctggaacactttgaagatcgggtgacaatggtggcgttgacgctggcgcagggtgacgaaacgctggccacccaactgaccgatgaaatgctttctggtcgctttcagcccgctaccccgacttttttaaattgcggtaaacagcagcgtggggaactggtctcctgcttcctgctccgtatcgaagacaatatggaatcgatcgggcgagcggtgaattcggcgctgcaactctccaaacgcggcggcggcgtcgcatttttactctccaatctgcgcgaggcgggcgcgccgatcaaacgcattgagaatcagtcttccggcgtgatcccggtgatgaaaatgctggaagacgcgttttcgtatgccaaccagcttggcgcgcgccaaggggccggcgcggtttatctccatgcgcaccatccggatattctgcgttttctggataccaaacgggaaaatgccgacgaaaaaatccggatcaaaacgctctctctcggcgtggtgatcccggacatcaccttccggctggcgaaagaaaacgcgcaaatggcgctcttttcgccctatgacatacaacgacgctacggcaaaccgtttggcgatatcgccattagcgaacggtacgatgaattaattgccgatccgcacgtgcgcaaaacctatattaacgcccgtgacttttttcaaacactggcggaaattcagttcgaatccgggtatctctacatcatgtttgaagatacggtaaaccgcgcgaatcctattgctggtcgcattaatatgagcaacctgtgctcggaaattttacaggtcaatagcgcctctcgttacgacgataaccttgactatacccacatcgggcatgacatctcctgcaatctcggctcgctgaatatcgctcacgtcatggattcaccggacattggccgtaccgtagaaaccgctattcgcggcctgacggcggtgtcggacatgagccatatacgcagcgtgccctcaatagccgccggtaatgccgcctctcatgccatcggtctgggccagatgaatctgcatggctatctggcgagggaaggtattgcctacggttcgccggaggcgttggatttcaccaatttctatttttacaccattacctggcatgccgtgcatacttcaatgcggctggcccgcgaacgcggcaaaaccttcgccggatttgcgcagtcgcgctatgccagcggcgactattttacgcagtatttacaggacgactggcaaccgaaaacggcgaaagtcagggcgctatttgcccgcagcggcattacgctgcccacacgcgaaatgtggctaaagctgcgcgacgatgtgatgcgctatggcatctataaccaaaatttgcaggcggtgccgccgaccggttcgatttcttacattaatcatgcgacctccagcattcatccgattgtggccaaaattgagattcgcaaagagggcaaaaccgggcgtgtgtattaccccgcgccgtttatgactaatgaaaacctggacatgtatcaggatgcttacgatatcggtccggaaaaaattattgatacctatgccgaggccacgcgccacgtcgatcaaggactgtcgctcaccctgtttttccccgataccgccacgacccgcgatatcaacaaagcgcagatctatgcctggcgaaaaggtattaagtcactgtattacatccgacttcgccagttggcgctggaaagtactgaaattgaaggctgcgtatcctgcgcgctataaggaaagccatatgaaattatctcgtattagcgccatcaactggaacaagatccaggacgacaaagatctggaggtgtggaaccggctgaccagtaacttctggctgccggaaaaagtgccgttatcgaatgatattccggcctggcagacgctgagcgccgccgaacagcagctcaccattcgcgtgtttacgggtcttacgctgctcgacactatccagaacatcgcaggcgcgccgtcgttaatggcagatgccatcacgccgcatgaagaggccgtactgtcgaacatcagctttatggaagcggtacacgcccgctcttacagttctattttctccacgctgtgccagacgaaagaggttgatgccgcctacgcctggagcgaagaaaacccaccgcttcagcgtaaggcgcagattattttagctcattacgtcagcgatgaaccgctaaagaaaaagattgccagcgtctttttagagtcttttctgttctattccggcttctggttgccgatgtatttctccagccgcggtaagctcacgaacactgccgacctgattcgtttaatcattcgcgatgaagcggttcacggttattatattggctataagcatcagatagcgctacaaaaactatcggcaatcgagcgtgaagagttaaagcttttcgcgctggatttattgatggaactgtacgacaacgaaatctgctacacagaagcgttatatgcggaaaccggctgggttaacgacgtcaaagccttcttgtgctacaacgccaataaagccttaatgaacctgggttatgaggcgttatttccgccggagatggcagacgtgaatcccgcaatccttgccgcgctctcgccgaatgccgacgaaaaccatgatttcttttccggctcaggttcatcttatgtgatggggaaaacggtcgaaaccgaagacgaagactggaatttttaaccttgcgggcatgggaaataacgttacattttccatgcctttatttcaagcaataccgggttaaatcgcgcaaatattacaacatgtcctacactcaatacgagtgacattattcacctggattcctccaattcaggtggatttttgctggttgtctcaaaaaatatctctccctccccattcgcgttcagcccttatatcatgggaaatcacagccgatagcacctcgcaatattcatgccagaagcaaattcagggttgtctcagattctgagtatgttagggtagaaaaaggtaactatttctatcaggtaacatatcgacataagtaaataacaggaatcattctattgcatggcaattaaattagaagtgaagaatctgtataaaatatttggagagcatccgcagcgtgccttcaaatatattgaaaagggactatcgaaagagcaaatactggaaaaaacggggctatcgcttggcgttaaagacgccagtctggccattgaagaaggcgagatatttgtcatcatgggattatccggctcgggtaaatccacaatggtacgccttctcaatcgcctgattgaacccacccgcgggcaggtactgattgacggtgttgatattgccaaaatatcagacgctgagcttcgcgaggtgcgcaggaaaaagattgcgatggtcttccagtcatttgcgctcatgccgcatatgaccgtgctggataatacggcattcggtatggaattagcgggcatcgcggcgcaagagcgtcgcgaaaagcgctggacgccttgcgtcaggtggggcttgagaattacgctcacgcctatccggatgaactttccggtgggatgcgtcagcgtgttgggcttgcccgcgcgctggcaatcaaccctgatatcttattaatggatgaagcgttttccgccctcgatccattaattcgtaccgaaatgcaggatgagctggtgaaattacaggcgaaacatcagcgcaccattgtctttatttcccacgatcttgatgaggctatgcgtattggcgacaggattgccattatgcaaaatggcgaggtcgtacaggttggtacgccggatgagatcctgaataatccggcaaatgattatgtccgcacgttcttccgtggcgtggatattagtcaggtctttagcgccaaagatattgcccgtcgcagtccggtcggcttaattcgtaaaacgccaggttttggtccccgttcggcactgaaattattacaggatgaagaccgtgaatatggttacgtcattgagcgtggcaataaattcgtgggcgtcgtgtccatcgactcattaaaagcggcattaagccaggcgcaagggattgaagcggcgcttatcgacgaccctttagtcgttgatgcgcaaaccccactcagcgagttgctctctcacgtcggccaggcgccctgcgcggtgccggttgtcgatgaagaacaccagtatgttggcattatttcaaaacgtatgttgctacaggctttagatcgcgaggggggtaacaatggctgatcaaacgaatccgtgggataccgcacaggtggccgatacgacgacgcaaacggctgatgcctggggaacaccggcaggcgtagccacggacggcggcagtaccgactggttgaacagcgcgcccgcgccagcccctgaacacttttctcttctggacccgttccataagacgcttatcccgctggatagctgggtcacagagggaatcgactgggtcgtcacccatttccgtcccctttttcaggggattcgtgtgccggtggattacatccttaacggctttcagcaactgctgctgggaatgcccgcccctgtggcgattattctctttgcgctgattgcctggcaggtttccggtgtgggcatggggatcgcggcgctgatatcgctgatcgccatcggcgcgatcggcgcctggtcgcaggcgatgattaccctggcgctggtgctgaccgccctgttgttctgcgtcgtgatcggattaccgatgggaatctggctggcgcgcagcccgcgcgcggccaaaatagttcgtccgctgctggatgcgatgcagaccacgcccgcgtttgtctatctggtgccgattgtcatgttattcggcatcggtaacgtgccgggcgtggtggtgacgattatttttgctctaccgccgattatacgcctgacgatcctgggcattaaccaggtgcctgccgacttaattgaagcgtcgcgctcgttcggcgccagcccgcgccaaatgttgttcaaagtgcaactaccgctggcgatgcccaccattatggcaggcgttaatcagacgctgatgctggctctctcaatggtcgtcatcgcctcgatgattgcggtcggtgggcttggccagatggtactacgcggcattggtcgtcttgatatggggctggcaaccgtcggcggcgtcggcattgtgattctcgccatcattctggaccgtctgacgcaggccgtcgggcgcgactcgcgtagccgcggtaaccgtcgctggtataccaccggtcctgttgggctaatcacccgccctttcgttaagtaactctcctgacgcccggtgacattgcgcttaccgggcttacaactccctaccataattaaaggaacaacgatgcgacatactgtgatatttgcctcagcgtttgccacccttgtcaccgccagcgctttcgctgccgacctgcctggcaaaggcattaccgtccaacctatccaaagcacgatttctgaagagtccttccagacgttactggtcagccgggcgctggaaaagttgggttataccgtaaataagccgagtgaagtcgattacaacgtaggctatacctccatcgcctctggcgatgcgacgtttaccgccgtgaactggcagccgctgcatgatgatatgtatgccgcagcaggcggagacaaaaagttttaccgcgagggcgtcttcgtctccggcgctgcgcagggctatctgatcgataaaaaaaccgccgagcagtacaacatcactaatatcgctcaactaaaagatccgaaaatcgccaaaatcttcgataccaatggcgacggaaaagcggacatgatgggctgctcgccgggctggggctgcgaagccgtaatcaatcaccagaataaagcgtttgatctgcaaaaaaccgttgaggtcagccacggtaactatgcggcgatgatggctgataccattacccgttttaaagaaggcaagccggtgctgtattacacctggaccccgtactgggtgagcgacgtaatgaagccgggtaaagatgtcgtctggctacaggtgccgttctcctccctgccgggcgaacagaaaaatattgatactaaactgccgaacggcgcgaactatgggttcccggtcaatactatgcatattgtcgccaataaggcatgggcggagaaaaatccggcggcggcgaaactgttcgccatcatgaagctgccgctggcggatatcaacgcgcagaacgccatgatgcatgccggtaaatcgtctgaagccgatgttcagggccacgtagacggctggatcaacgcccaccagcagcagtttgacggctgggtgaaagaagcgctggccgcgcagaaataatatcgttttttatgccggataaggcgcagttcatgcgccgctatccggccaacgcaatctctcctcaaagcgcacgattcatcacgtcactgttcccctttattcatcaacatccgctatgattgttttcccaggaaataattatctaaatcacgattaccataatgacgaaacccactcatgggcttagcccggcgctgatcgttttaatgtctgtggccacgggtctggcggtcgccagcaactactatgcccagccgctgcttgataccatcgcgcatcacttttcgctttccgccagctccgcagggtttatcgttaccgccgcgcagttgggctatgccgctggcctgttgtttctggtgccgctcggcgacatgtttgaacgccgaacgctgattgtctccatgacgttgctggcggctggcggaatgctgatcactgccagcagtcagtcgcttagcatgatgatactcggaacggccttaaccggactgttctccgtggtggcgcagattctggttccgctggccgccacgcttgcgacgcccgccacccgcggtaaagtggtcggcaccattatgagcggcctgttgctggggatcctgctggcgcgaacggtcgccggactgctggcaaacctcggcggttggcgcaccgtattttgggtagcgtcggcgctgatggcgctgatggccgtcgcgttgtggcgcggactgccaaagctcaaatccgacacccatcttaactacccgcaactgttgggttctgtattcagcctgtttattcacgataagctgctgcgtacccgcgcgctgctgggctgtctgacctttgctaatttcagcatcctctggacgtcaatggcctttttgctcgccgcgccgccgtttagctattccgaggggatgattggcctgtttggcctggcgggggccgccggcgctttaggcgcgcgtccggctggcggatttgccgataaaggtaaatctcacctcaccaccacgttcggcttactgctgctgttactctcctggctggctatctggcttgggcgcacctcggtactggcgctgattattggtattctggtactggacctcaccgttcagggggtacatatcaccaatcagacggtcatctatcgtttgcatccggatgcgcgtaaccggctcaccgccggctatatgaccagctactttatcggtggcgccgcggggtcgctgatttccgcctccgcctggcaacatgccggctgggccggcgtttgtctggcgggtgtcacggtagccttacttaatttactggtctggtggcgaggttttcaccgacaggaagccgtaaattaagcggatagtgagcgtttacctttgtttaagctccttagggtgttaaggagctccccagtctgttaaggttatgctattcatttatcatggttatttttataccggtgaagaataatataattctatggaaagccctgcatccccatctgctcccaggccaatagcgcccgttcaaggattcgaaggtcgttcaccgatagctattcgtgatattccggtggcttttgcatcgggttgtaaggccgtttacccggctttcgcccctcccgcttatcgttctctcctgattttttcatgcaggcactcacgcttttctcgtcattcctggatttgccgcaggcggcgctttaccgggcccaatgttcccgctgacgtctcagtctgcgtatcattggttgctttatagcctgaaagaatgattttgtattaataatacatttactttatttgtcactgtcgttactatatcggctgaaattaatgaggtcatgcccaaatggatagttcgtttacgcccattgaacaaatgctaaaatttcgcgccagccgtcacgaagactttccttaccaggaaattcttttgactcgtctttgtatgcacatgcaaggcaagctcctggaaaaccgcaataaaatgctgaaggctcaagggattaacgagacgttgtttatggcgttgattacgctggagtctcaggaaaaccacagtattcagccgtctgaattaagctgcgcgctgggttcatctcgcaccaatgcgacacgcattgcagatgagctggaaaaacgcggctggattgagcgtcgtgagagcgataacgaccgccgttgcctgcatctgcaattaacggagaaaggccaggcatttttgcaagaagtgcttccgcctcagcatcattgtctgcatcaactctggtcatcacttagcacagccgaaaaagatcaacttgagcacatcactcgtaaactcctgacgcgtcttgatcaaatggagcaggaaggcactgttcttgaggcgctgcgctaaagcgccgacccgctcaaaaatccagattaataacaggaaagcggacaggccggcacgcgttactgctggcctttctgacaacaggtcggctcagccgatgtgaataataagatcgtggagaacaacatgagcgcaaatgcggagatccaacccccgcagcaaccggctaagaagaaaggcaaacgcaaaacagcgctgctacttcttaccttgctctttgttattattgccgtggcatatggaatttattggtttttagtattgcgtcatattgaagagacagatgatgcttacgtggcagggaaccaggttcaaatcatggcgcaggtgtcaggcagcgtgacgaaagtctgggctgataacaccgactttgtaaaagagggcgatgttctggtcacgctcgatcagactgacgccaaacaagcgtttgaaagagccaaaacggcgctggcctccagcgtgcgccagacgcaccagttgatgattaacagtaagcagttgcaggcgaatatcgacgtgcaaaaaaccgccctggcgcaagcgcagagcgaccttaaccgtcgtgtgccgctgggtaatgccaatcttattggccgggaagagctgcaacacgcccgcgatgccgtcgccagcgcgcaggcacagcttgatgtcgccattcaacagtacaatgccaaccaggcaatgatacttaacagtaatctggaagatcagcctgcggttcaacaagcggcgaccgaagtgcgtaacgcctggctggcgctggagcgtactcgcatcgtcagtccaatgaccggttatgtctcccgccgcgccgtccagcctggcgcgcagatcagccccaccacgccgctgatggccgtggtgcctgcaaccgatctgtgggtggacgctaactttaaagagacccaattagcgaatatgcgcattgggcagccagtgacgattattactgacatttatggcgacgacgtaaaatacaccggtaaagtcgtcggtctggatatggggacaggtagcgccttctccctgctgcccgcgcaaaatgcgacgggtaactggattaaagtggttcaacgtctgccggtacgcgtcgaactggacgcccgccagttagaacaacatccgctgcgcattggtttatcgacgctggtcaccgtggataccgctaatcgcgacggtcaggtactggccagccaggtacgaacgacgccggttgccgaaagtaacgcacgcgaaattaatctcgcgccggtcaataaactgatcgacgacatcgtacaggctaacgcgggttaatcctgaggtgcgtgtgatgcaacagcaaaaaccgctggaaggcgcgcagctcatcatcatgacgatcgcgctgtcgctggcgacattcatgcaggtgctggactccaccattgccaacgtggcgattccgaccatcgccgggaacctgggttcttccctaagccaggggacatgggttatcacctctttcggggtggcgaacgctatctcgattcccttaaccggctggctggcgaagcgttttggcgaagtcaaactgttcatgtggtcgacggtcgcctttgccgcggcctcctgggcctgtggcgtatccagcagcctgaacatgctgatcttcttccgcgtggtgcagggcgtggtcgccgggccgctgattccgctctcgcaaagcctgttgctgaataactatccgcctgcaaagcgctccattgcgctggcgctctggtcaatgaccgtcattgtcgcgccgatttgcggcccgattctggggggctacatcagtgataattaccactggggatggattttcttcatcaacgtgccgattggcatcgccgtcgtcctgatgacgttacacacgctgcgcggacgtgaaactcataccgaacggcgacgtattgacgccgtcgggctggcgttactggtgattggcatcagcagcctgcaaattatgctcgaccgcggtaaagagctggactggttctcctcgcaggaaattatcatcctgaccgtggtcgccgtcatcgccatcagtttcctgatcgtctgggaactgaccgacgatcaccctatcgtcgatctttctctttttaaatcgcgtaacttcactattggctgcctgtgcatcagccttgcctatatgctctatttcggcgccattgttctattgccgcagcttttgcaagaggtgtacggctataccgcaacgtgggcaggtctggcgtcggcgccagtcggtattattccggtaattttgtcgccgattatcggacgcttcgcgcataaactggatatgcgcaggctggtcacattcagcttcattatgtacgccgtctgtttttactggcgcgcctggacgttcgaaccgggtatggatttcggcgcttccgcatggccgcagtttattcaaggatttgccgtcgcctgcttctttatgccgctgaccaccattacgctctccgggttaccgcccgaacggctggcggcggcatcaagcctgtcgaacttcacgcgaacgctggcgggctccattggcacctcgattaccaccactatgtggaccgatcgtgagtcgctacaccatgcgcagctcaccgagtcggttacggcgtataatccaaacgctcaggctatgtacgataaactggaaggcttagggatgacgcaccaacaggcgtcaggctggatagcccagcaaatcacgaatcaggggctgattatttccgccaacgaaatcttctggatgtcggcggggatcttcctggtgctgctcggcctggtgtggttcgccaaaccgcccttcggtgcgggcggcggcggcggtggcgcgcactaactatctgataaaagggatctacggatcccttttttagtagaccaacaatcagaagaaatatttgaatctcagacgcccgccgtaacgcgcatcttcactgttatcgccattattcggattggcctctacccatgaagcataggcgccgaggtagatgttaaagtttttcatatccatcacgttggggaataaatatgaggcatgaatagtgtggatgtcataattgccgggatcggtgatccagcaatcgtcctcacaaacggcatcgatattggtagcattaaaggcttcgattttgttatgcgcatagatataacccagttcaaatcgatgccacagcgcattcaccccagcggtaaaatctgtctcatcggtcgcatccatataagcggtattcaggttaataactgcgccatcttccgggtcagttttttgaccattccaggtcatggtaaaaccatagcccgtacgatctgactgatcgatccacttcccattctcataatagccataggcgttgttaacgacgttactttccatcgctatcgccgttgaaaaacgcccgttttgccaggcaataaccggacggacgtaagccacgtttttatcgttggttaaatccattccgtggtactgcttctcggtatataacgtactgccattttccagcaatgtgttaacttcgaaataccagttgtcgatggttttgctcagcaggaagttacccccactgtcgctacgtccccgtccttctttcatcatatagatatagccgtaaccgtcactgtaaagatcgttcgctgtattccccgaatattcaataaatgtatcctgattcagcgggaacatatcgtaggcttcaaaacgaccaaccttaattttccagtcattctcacgaccaaagaagaaaacggcatcatcaaggttcattttcccggtcagatccgccagaggctgtacagagaatccggcaaaattaccgttgtccagccgctggtagccatcaaagcccagcaacaggcgcccgttaatatcccagcgttcattggttcctgatgcccaatctttattcgctgacgttctcatcgaggtcaggctaccggaacggcttgccgcatccatattaaattcgacatcgccatagaacttaatatcgctgaatccggataaggtcagcttcggcggcgttttatctgctgcaatgggctcggcggactggacattcaccgtcggtgtagcggcgacctgctgctgtttcagcgagcgaatttgcgcctcggcatcggatgcccgtttttcagcattaacaacacgttgctccagttcagccagacgctgctcaatagtgatatcattcgctgcccaaaggttatgagaaaagcaagcaccgatcatcagcgccaaatatttagccttcattttttatcccttaagtttgatgtataccagataagatttgctaaaaaccccatcgaccggctattagtagagtcttgttattacctggatatctggcgcattccattatgtttttctattaattatttatgatttttagtttatgtgatcaatacactctggcatcgtgagttatccgccttttctgtttaccagatcacattttattatttaacaggccaggcattacttaatttaaaatgtattctcgccgcaaatataataaacgcaaattatattaagcaataaaaaaccccggccataaaccggggttaatttaaatactggaaccgcttaccaataagactaaatatgcaattcctgcagtttttctttcggcagcgccagctctttattgctgttcacgcgcacatcacgctccagaatatgacgggcaatgtcctgcgcttcactgagcgagtgcatctgatacgtaccgcactggtaaacgttcagctccgggatctggttttgatcctgcactttcagcacatccgccatcgccgctttccaagcgtcggcaacacgctgctcgtccggcgtgccaatcaggctcatgtaaaagccggtgcggcagcccatcggcgagatatcgataatctcaacgccgttaccgttgaggtggtcgcgcataaagccagcaaacagatgctcaagcgtatgaatccctttttccggcatcacttctttgttcggaatgcaaaaacgcagatcaaacacggtgattgcgtcgccatgcggggtgttcatcgtttttgcaacccggaccgccggcgcttgcatccgggtatgatcgactgcgaagctatctaataatggcatttagtcacctccgataattttttaaaaataaactgaactctttgttccggggcgagtctgagtatatgaaagacgcgcatttgttatcatcatccctgttttcagcgatgaaattttggccactccgtgagtggcctttttcttttgggtcaggcgtgtttcgcaagccacgcggcaaacggctcggtatccgccgcctcaatctcctgctgacgacgtactgaagcgtcacgttcagcaataaactcttcttcctgtaaaatctccagcggctcttcgcgtaacagattacggtaagcctcaccgaacgctttcccagtgccgccaatgccttcatcaatcatagaccgtaagattcgggcagagaatgtcagttcaggattatcaaagcaggcgaccaactcatcacacaccttttgatactcctctcccccgtggatactgtccagcgtttgcgccacgcgtttcagatcgcggaagagatctttccctactttaggcagcgggaactgcgcggtttcacagccaatccccagggtaaggcccggcttacgcccttccagaataacgcgattccagttagtacgcgtacataacagctcatcgctactcatttccggcgcatcggccaatacgcaccagaccataaacagatcgaggaagcgcacctgttgctcgtctacgccgatcggtgagaacggattaatatcgagagaacgaacttcgatgtactcaataccaccacgcagaagcgcatctgaaggcgattcgccgctgcgcgtcacgcgcttgggacgaatgggcgcgtacagctcattttcaatttgcagaacgttgctgttaatctgtagccgcttaccgtctttttccacaccaatccgcgcgtactcttctgacggcgttttaatcgcccgtttcagacctgcaacgtattcatgtagatcgttaaacgtaatacccagattgctttgcgacttattggtatagcccaaatcactcaaacgcagcgacgtcgcatatggcaggtagtacatgccgcagtccgttttttcaaacggtaatgtggttggcttcccttgcaggaaagaggaacaaatggccggagacgcgccaaacagataggggatgacccagccaaaacggtaatagttgcgaatcagacgaaaatagccggcagaaattttttcttttgccgcttcgccttccgtaacgccgcatttcgcctgccagaacgccatcggtaatgaaaaattgtaatgtacgccggaaatggtttgcatcaaagcgccataacgatttttcagcccttcgcgatagagcgtcttaaagcgcccggtatttgatgtgccgtactgcgccagctctatgtcctgcccttccgcaatatagcagggcatacttaatggccacatccgctcatcgcccagtttcctggccgtataccgatggagatcgcgcataaaggtgagcatatgctggatatcgccatcgactggcgtaataaactccagtagggcttccgcaaaatctgtggtaatccatttatgggtcagcgctgaacctaacgcttcaggatgaactgttgtcgccagcgtgccatcagcattgacacgcagcgtttcgcgctctaacccgcgctgtatcccctttaacgcctgaggatgtttttccagccaggccagagcctgtgatacgtccgggatcaaattgacctcccgcctgtccaaatcgttttaataagcataactgtaatggcggccatacatgccaaacctacaattattaccaccacatcatgccctgaaccgtcgccgctgcgagcgcaacatagcgcagcgccttaccaagacacaaaaaaaagatcgtccgcccccacgggatgcgcatccatcccgctaacaggcacaacaaatcaccgatgaccggcatccagcttaataatagtgtggctgcgccataacgctttagccagccagtcgctttttcctgccaacgcgacgttttgcgcagcggaaagaaacgcccaagaataacgttagttacccctccaaggctattacccattgttgctgttaagactaagacccagggatgactgacgccggagaccagcatagcaaccaaaaccacctcagaattaccgggtaacagcgtcgcgctgagaaaactactggcaaacagagacaggagcgacagtccgtcactcacaatagtcggacatccacggcatccattcccgccgcccgcgccgcctgtaaaccaaaatcggcatcttcaaataccacgcactgcgtcggcatgacgcccatccgctgggcgcacaataggaaggtgtcaggcgcaggtttgtgatgctgtacgtgatctgccgccacaaccgcatcaaaataacgacgcagccccagatgcgctaacaaggcttccgcgatagcgctttcgctaccggtaccgaccgacatgggacgccgcccatgccacgctttgaccacctcaaccagcggcagcggttctacgcagtccagcaggatgctttttaccgcgtcggttttctcacgcgccagtgacaggggatcaagatcggcatggttaagctcaatgattgactgggcgataagccaggttggcgaaccgttaagcgcgaccattgcctgttcatcaaaacgaagaccatagcgccccaaaacctcacgccacgctttgcgatgcgtgggttcggtatccaggagagtaccgtccatatcaaaaatcaaaccagcataacgtgcgtacatcgtgttctcgcaaaccgaataaccagacagtactttatcgcaattggttgattttgtcgctaatagagatgaagaggtatattcaggataagggggaaaagcgattgcagggcagtaacgtatccgggaggattactcgcccttcgggccgttgctgatgcaacgttatccttctgatgccagcggtgattaccgctatcttatctgcatcttcatcgctgaaagtatggagaatatggtgcatccgggaggattactcgccttacggctcgcccttcgggccgttgctgacgcaacgttatccttcctggtgcctgcggtgattaccgctatcttatccgcatctttatcgctgaaagtatggagaatatggtgcatccgggaggattcgaacctccgaccgctcggttcgtagccgagtactctatccagctgagctacggatgcattgggaaacttgctttactgctgatattgataccgcggtgaaagccgtatcaattaagagatggtgtatccgggaggattactcgccttacggctcgcccttcgggccgttgctaacgcaacgttatccttcctggtgccagcggtgattaccgctatcttatccgtatcttcatcgctgaaagtacggagaatatggtgcatccgggaggattcgaacctccgaccgctcggttcgtagccgagtactctatccagctgagctacggatgcatcggaaaacttgctttactgccgatattgataccgcggtgaaagccgtatcaagtaagagatggtgcatccgggaggattcgaacctccgaccgctcggttcgtagccgagtactctatccagctgagctacggatgcatcgggaaacttactttactgcagattttgataccgcggtgaaagccgtatcaagtaagagatggtgcatccgggaggattcgaacctccgaccgctcggttcgtagccgagtactctatccagctgaagctacggatgcaaatggcggtgaggcggggattcgaaccccggatgcagcttttgaccgcatactcccttagcaggggagcgccttcagcctctcggccacctcaccacacgcctcttacgagtgcttcgaagaacttgttctgctcatcgtcgctgcgtggcgcacatattactttctgggacttataagtcaaacaatttttccagagcttttatcgtttgcacacttcacgctcaattagtctataaaaaagccaaaaagagtgttttatcaacagataatttgatgacacgctggccgccaaaagcgcaccatatcaacagtgaggttgaaaaaagtcatgaggggacaacgcgggcgagcgagaagagaggctgcgtctcacccgaaaagtgagacgcgaaaaccttagtaactggactgctgggatttttcagcctggatacgctggtagatctcttcacgatggacagaaacttctttcggggcgttcacgccaatacgcacctggttgcccttcacccctaaaactgtcacggtgacctcatcgccaatcatgagggtctcaccaactcgacgagtcagaatcagcattctttgctccttgaaagattaaaagagtcgggtctctctgtatcccggcattatccatcatataacgccaaaaagtaagcgatgacaaacaccttaggtgtaagcagtcatggcattacattctgttaaacctaagtttagccgatatacaaaacttcaacctgactttatcgttgtcgatagcgttgacgtaaacgccgcagcacgagctgcggcgccaacgaacgcttataattattgcaattttgcgctgacccagccttgtacactggctaacgctgcaggcagagctgccgcatccgtaccaccggcttgcgccatgtccggacgaccgccacccttaccgcccacctgctgagcgaccataccaatcaattcccctgctttaacccggtcggtcacatccttcgacacgcccgcaatcagagaaaccttaccttcaacaaccgttgccagtacgataacggtagaccccagttgatttttcagatcatcaaccatggttcgcagcattttcggctcaataccagcaagctcgctgaccaggagcttcacgccgttgagatcgaccgctttactggaaagatttgcactctcctgcgctgcggcctggtccttcaactgctgcaactctttttccagctgacgcgtacgttccagcacggcacgcactttgtcgcccagattctggctgtcgcccttcagcagatgcgcaatatcgtttaagcgatcgctttgcgcgtgaacggtggccatagcgccttcaccggttaccgcctcaatacgacgaatgcccgctgcggtgccggactcagagataatacggaatagaccgatatcaccggtacgactggcgtgagtaccgccgcacagttcggtagagaaatcgcccatgctcagaacgcgtacacgttcgtcgtatttctcgccaaacagcgccatggcccctttcgccttcgccgcgtcgagatccatgatgttcgtttcaatcggcaggttgcggcgaatttgcgcattcaccaaatcttcaacctcacgaatctccgacggcttcatcgcttcattgtgcgagaagtcgaagcgcagcactttatcgctaaccagcgaacctttctgcgcaacgtgtgtcccaagcacctggcgcaacgccgcgtgcatcaggtgcgtggcggagtggttcagacggatacgtgcgcggcgcgcttcatctacgtcagcctgtaccgcatcgcccactttcagagcgcccgcagacaatttgccgaggtgaccaatcgcctgaccatatttttgcgtgtcgtccacagcgaaagtaaatccagcgcctttcagctcgcctttatcgccaacctgaccgcctgattccgcatagaatggggtctgatccagcacgacaacagcttcctgtcccgcgttaatcgcttcaaccgctttaccatcgacaaacagcgcagtcactttgccgttcagttccagatggtcataacctttaaattcagaagcgctgtcaacgcggatcatcgcgttgtagtccgcgccaaaaccgctagcttcgcgcgcgcgacggcgttgctcttccatggcggcttcaaaaccggcttcgtcgactttgatgttgcgctcacggcagacgtccgccgttagatcgaccgggaaaccataagtatcatacagacggaaagcggtttcgccgtccagggtgtcgccctgcaatttcgccagttcttcatccagcagcgccagaccgcgctccagcgtacgagcgaactgctcttcttccgttttcagaacctgctcgacctgcgcctgctgacgtttcaactcttcgcctgcggagcccattacctcaatcagcggcccaaccagcttgtagaagaaggtctcttttgcgcccagcatgttgccgtgacgaaccgcgcgacgaataatgcgacgcagcacatagccacggttttcattcgacggcagcacgccatcggcaaccaggaatgcgcaagaacggatgtggtcggcgataacgcgcagcgatttattacccaaatcggtggagccggtgactttcgctaccgcttcaatcaacgtgcggaacaggtcgatgtcatagttagagttaacgtgttgcagtaccgcggcaatacgctccagccccataccggtatctacagacggtttcggcaatggttccatcgtcccgtcagcctgacggttgaactgcataaagacgatgttccagatttcaatatagcgatcgccgtcttcttccgggcttcccggagggccgccccagatgtggtcgccatgatcgtagaagatttcggtgcacggaccgcagggaccggtgtcgcccatctgccagaagttatccgatgcgtatggcgcgcctttattgtcaccgatacggatgatacgctcgcgcgggatgccgacttctttttcccagatctcataggcttcgtcgtcggtttcatagacggtgacccataagcgctcttttggcagagcaaaccagttttcgccggtcagtaattcccatgcgaactgaatggcgtcgtgtttgaaataatcgccgaagctgaagttgcccagcatttcgaagaaagtatggtgacgtgcagtgtatccgacgttttccagatcgttgtgtttaccccccgcgcgtacgcaacgctgggaagtggttgcacgggaataattacgtttatcgagcccaaggaaaacatccttgaactggttcatcccggcattggtaaacaacagagtggggtcattgttaggcaccagggaactgctggcaactacctgatgccctttactatggaaaaagtcgagaaacgcctgacggatctcagcggtgctcttgctcataattatcctgaaatcaagctacactccatccttcaggccgcctctgcgttggctgcgagtttcccggtcacgcgttcccgaggctcacttgccgctttaatgcggcttgaatgattttgtgtatttaaggaatattcgtcgcagacgctgttcgccgttaagcaacccgcgtccagacggaaaaagtgggaataagataagttttctttaccgggaagtaaaatcccgtatgcgctcaatctgcaaaatttcgccatatttgctggatatcgtccatcagatacccgcgatagagcaaaaagcgctgtaccttaaccttttctgaaaagtttgaagggagcggctcgccatatttgcgaacggcctgttcacgtgccatttcactccagtcaatttcacattctcgcatcgctttttcagtcgattcacgggaaatgcctttctgattcaactcctggcgaatacgcgccgggccatagcctttgcggctacgactggcgataaagcgcatcacgaagcgctcgtcatcaagatagtggtgttcgtggcaccaggcgatcacgcgttcataatcgtctgccgtcgcatcaatctcttccggcccatttttgcccatcaccggcgcggagagtttacgccgtagttcctgctcgctgtgatcgcggacagcaagaatacgtaccgcacgatcaaggagacgagcataagcgggacggcgcgatgtgggttcactcataaaaaaccttaacaggggtaaatgccaaaagggccgcataaatgcagcccttgatggtaatttaacgttttgctgaatggcggcttcgttttgtccgacccaccatcacctgatgattaaaaatcttcgttggtttctgcaacgccttcgctatcgtcaacggcgaaatcgggcgtggcattctgattactcaacagtaattcacgcactcttttctcgatctctttcgctgttgccgggttctctttcagccaggtagtcgcgttcgctttaccctggccaatcttctcgccgttgtagctgtaccatgcgcccgctttctcgatcagcttctctttcacgcccaggtcaaccagttcgccatagaagttgatgccttcgccgtagaggatctggaactcggcctgcttaaacggcgcggcgattttgtttttcaccactttcacacgcgtttcgctacccacgacattatcgccttctttcaccgcgccaatacgacggatatcaagacgaacggaggcgtagaatttcagcgcgttaccgccggtggtggtttccgggttaccaaacatcacgccaattttcatacggatctggttgatgaagatcagcagcgtattggactgtttcaggttccccgccagcttacgcatcgcctggctcatcatacgcgccgcgaggcccatgtgagagtcgccgatttcgccttcgatttccgctttcggcgttagcgccgctacggagtcgaccacaatgacgtccaccgcgcctgaacgcgccagcgcgtcacagatttccagcgcctgctcgccggtatccggctgagaacagagcaggttatcgatatcgacgcccagcttgcgtgcgtaaacagggtcaagcgcgtgttccgcatcgataaacgcacaggttttaccttcacgctgcgcagcggcaatcacctgcagcgtcagggtcgttttaccggaagattccggcccgtaaatttcgacgatacgccccatcggcagaccgcccgcaccgagtgcgatatccagtgaaagcgaaccggtggagatagtttccacatccatagaacggtcttcacccagacgcatgatggagcctttaccaaattgcttttcaatttggcccagtgctgccgccaacgctttctgtttgttttcgtcgatagccattattactcctgtcatgcaacttggtattgaaccggatagtgaattcgtactgttgaagcaattatactgtatgctcatacagtatcaagtgttttgtagaaattgttgccacagggtttgtagcgcgtatgtcgtcgcctgtcgacgcaccgattcacggtcgccgctgaagcattcccgacgcgtaatcccttctccactgacgctggcgaaagcaaaccacaccgtaccaaccggcttttcttcactgccgccatccggcccggcaatcccgctaatagcgacagcaaaatcggcgcgagcggccttcagcgccccgatcgccatttcgaccactacggattcgctgaccgcgccatgctgcgccagcgtctcttcacgcacgccaatcatctgcgctttggcttcattactataggtgacaaagccgcgttcaaaccaggcggaacttccggcgatgtcggtaatggctttcgccagccagccgccggtacaggactccgctgtcgttacggtcgccccgcgcgcttttaacgccagcccgacctgttcgctaagccgcatcagttcactgtcagtcatcatgacctctgtcagttagaaatcctgccgcacaagatagcactttctcaccagagatggggacgagctgtcgattttacgagtcggattccgaaaaaatgccagcaggttatttatgcagaatgaaagaggtagcacatgactaaatagcagtactatgtcgctaaatttacacgcacggagagaaagcaaggatgtcactcaaaaaaacggaaagcgcacagcacaaactgaaacaaacctgtcaactacggctgtggttaattgtgggtggagtatgttcattaggaatgggagtactgaatatattgtcgtcaggctattttgaaccgtatgacggcggtcaaattatcttaggcctgggatgtctgggttatagtctggcactatcaaaaaagatatcccacttgcaagcccaaaaagccatagtaatagcggaggggggctcccctccctaagcgtaaattagcgcacccgcgccagcgctaccgcctgccccagttgccaaaccgccatcgcataatgcgtgctgtggttatatcgggtaatggtgtagaagttcggcaggccgtaccagtactggtatcccgtaccgatatccagacgcagcaggctggcttcctgatgattgcccaacgattgctgcggcgttaagcctgcggcggcaagctgagagatgctgtattttgttttgaaaccattcgccaacccaggcgcctgaccactcgccggcaccgcaaccatatcgcctttcacccaaccatgcgccttgaaatagttcgccacgctgccgatggcatctaccggatcccacaagttaatgtgcccatcgccattgaaatcgaccgcatattctttataggaagacggcataaactggccgtagcccatcgcgccggcaaaggaacctttcagattgagcggatcgtcttgctcatcgcgcgccatgagcaggaaggtttccagctcgccggagaaatattccgcccggcgcggatagttaaatgacagcgtcgccagcgcgtccagaatccgtgttttccccatgatacgtccccagcgggtttccacgccgatgatgcccacaatgatttccggcggtacgccgtatacctgccaggcgcggttcagcgcgtcttcatactgattccagaacgcgacgccgttttgcacgttatccggcgtaataaattgtttgcggtagcgcaaccaggcgccatttggtccggcgggcggctgagtggtcggcgcttgtctgtccatcagacgcagaacgtaatccagtcttttagactgcgagaggatctcttgcagctgctgacggtcgaaaccgtgtttactgaccattttatcaatgaactgctgcgcattagggttgttggcgaagtcgccgcccatttgcatgacgttatgctgcggctcaagcaggaagccgccggaaggcgtgcccgtcgtcgcttgagtctcggaagattttggcgtgctgctacaggcagcaagcaatacgcaaagtggaagtaacgctacataacgacgcttgaacatgagacatccattaaacaaattcagtcagggagaagtatggtaaagcatccccccgccgcacaaggaagcggcacaagagaataaatcacctttcccctctctccagtttgtatctgctcctccactccctcaatctttcaagttaaaatatttttcttttattttgagatcaaaataacacttttatacctttcaacatgattacaatgagcaggaagttagcaagaaaactaaaaaccctacaggagagaacaatgatcgaaaccattacacatggtgcggagtggttcatcgggttattccagaaaggcggtgaggtgtttaccggtatggtgacaggtattcttccgctactgataagcctgctggttatcatgaatgcgctcatcaattttatcggccagcagcgtattgagcgttttgcccaacgctgcgccggaaatccgctatcccgctacctgcttttaccgtttatcgggacgtttgttttttgtaatccgatgaccctgagtctgggacgctttatgccggagaagtacaagccgagctattacgcggcggcctcctatagctgtcactccatgaacggtctgtttccgcatatcaatcccggcgaactgtttgtttatctgggtatcgccagcggactcaccacgttagggcttcctctcggcccgctcgcggtgagctatctgctggtaggtctggtgacgaacttcttccgcggttgggtcaccgatctcaccaccgctatttttgagaaaaaaatggggattcaacttgagcagaaagttcatctgacaggagcggtatcatgacacgggttcgcattgagaaaggtgccggcggctggggcggcccgcttgaactggacgttacgccaggcaaaaagatcgtctatatcacagccggtacgcgcccggcgatcgtcgacaaactggcgcaactaacaggctggcaagcggtggacggctttaaagaaggcgaaccgccggaagcggagatcggcgcggccattatcgactgcggcggtacgctgcgctgcggtatctacccgaaacgccggattccaaccattaatattcactcgacgggtaagtccggcccactggcgcagtatattgttgaagatatttatgtctccggcgtaaaagaagaaaacattactctagtcggcgaaacatctgccagaccccagcctgccaaaacgacattaggacgtgactacgacaccagcaaaaaaatcaccgagcagagcgacgggctgctggcaaaagtcggtatgggaatgggttctgccgtggcggtactgttccagtccggtcgcgacaccattgatacggtcctgaaaacaattctgccgtttatggcgttcgtttcggcgctaatcggcatcattatggcctcaggtcttggcgactggatcgcccacggcctggcgccattagccagccatccactggggctggtgacgctggcattgatctgctctttcccgctgctgtcgccctttctcggcccaggcgcggttatcgctcaggttattggcgttctgatcggcgttcagataggtctgggcaatatccccccgcatctggcgctgcccgccctgttcgcgattaacgcgcaggcggcctgcgactttatcccggtcggcctgtcactggcggaagcgaaacaagacaccgttcgcgtcggcgtaccttctgtgctggtcggacgcttcctgaccggcgcgcccacggtacttatcgcctggtttgtttccggctttatctatcaataagaggttcagacatgagcgtgatttatcaaaccaccatcacccgcatcggccagagcgcgatggaggcgctcggcgaaaagatgctgattacgtttcgggaaggcgcgccggcggatatcgaagaattttgcttcatccattgtcatggcgaactgaccggcgcgctgcagcctggcgcgcggtgtgaactgggccaacattgctatccggtcacggcggtcggcagcgtagccgagcaaaacctgcgtgaactggggcatatcaccttgcgctttgatggtctgcgcgaagcggaatttcccggcaccgtacacgttgcggggcctgtaccggacgatatcgcgccgggctgtattttgacgtttgtcgcttaaggagaaaaaacatgaatcaagttgccgttgtcattggcggaggccagaccctgggggcattcctttgccgtgggcttgcagaagaaggataccgcgtggcggtcgttgatattcaaagcgataaagccgcgaatgtcgcccaggaaattaacgccgattttggcgaaggtatggcctacggttttggcgccgacgccaccagcgagcagagcgtgctggcgctgtcccgcggcgtagacgagattttcgggcgcgtcgatctgctggtttacagcgcgggtatcgccaaagcggcgtttatcagcgatttccagttgggcgattttgaccgctcgctacaggtgaatctggtgggctatttcctctgcgcccgtgagttttcccgcctgatgatccgcgacggcattcaggggcgcattattcagattaactctaaatccggcaaagtgggcagtaaacacaactccggctacagcgcggcgaaattcggcggcgtggggttaacccagtctctggcgctggacctggcggaatacggcattaccgtacactcgctgatgctcggcaacctgttgaaatcgccgatgttccagtcattgctgccgcaatacgccactaaactgtgcattaagcccgacgaggtggaacagtattacattgataaagtaccgctcaaacgcgggtgtgattatcaggatgtgctgaacatgctgctattttatgccagcccgaaagcgtcttattgcaccgggcagtcgatcaacgtaaccggcggtcaagtgatgttctgaccgtgaattgccggatggcgccgtaggccggataagacggttacgccgccatcaggcaaaacaacaggagcacattatggtttccactctgattaccgtcgccgttatcgcctggtgtgcacaactggcgctgggcggctggcagatttcccgctttaatcgggctttcgataaacttagccaacagggacgggtcggcgtcgggcgctccggcgggcgttttaagccccgggtggtggttgccgtggcgctggacgaacagcagcgggtgacggacactttattgatgaaaggccttacggtattcgccagaccggttaaaattgccgcaatgcaaggaaaacatttgcatgaattacagcctgatgtgatctttccccatgattcgctcgcgcagaatgcactatcattggcgcttaaactgaaacatgggtaatttcgttgtgaatgcgaatagcttgcgaaattatcattttgcaacctataccctaaataattcgagttgcaggaaggcggcgacgcagcgaatcccctggaacgtacatcaatacgtgaccggggtgagcgaggaaagccaacgcacatgcagcgtgaagtattacgggtaaatacataagtcagggtaatcacgcctatgaaacctcgtcagcgtcaggccgcgattctggagcacctgcaaaaacagggaaaatgctcggttgaagaactggcccagtactttgacacgacaggcaccactatccgtaaagatctggtcattctggaaaatgccggaaccgtcatccgcacctatggcggcgtggtgttgaataaagaagagtccgatccgcctattgatcacaaaacgcttatcaacacccacaaaaaagcgctgatagccgcagccgctgtgaaatatatccatgatggcgattccattattctggacgccggaagtaccgtgttacagatggtgccgttgctttcgcgttttagcaacatcacggtgatgaccaacagcctccatattgttaacgcgctatcggaactggacaacgaacaaactatcctgatgcccggcggcaccttccgtaaaaaatcggcgtcgtttcacggtcaactggcggaaaacgcctttgagcaattcagctttgataaacttttcatgggaactgacggtattgacctgaatgtcggtgtgaccacgttcaatgaggtttacaccgtcagtaacgcaatgtgcaatgcagcacgcgaggtgattctgatggcggactcctcaaaatttggtcgtaaaagccccaatgtggtgtgcagtctggaaaccgtcgacaaactgatcacggacgcggggatcgatccggcatttcgtcaggcgctggaagcaaaagggattgaagtaatcataaccggagaaagcaatgagtgatgcactactaaacgcgggccgtcagaccttaatgctggagctacaggaagccagccgtctgccggagcgtctgggcgatgattttgtccgcgccgccaatatcattattcactgtgaaggcaaagtgatcgtttccggtattggtaaatcaggtcatattggtaaaaaaatcgccgcgacgcttgccagtaccggtactcccgctttttttgttcatccggcggaagcactgcatggcgatctggggatgattgaaagccgcgacgtgatgttatttatctcctattccggcggcgcaaaagaactcgacctcatcatcccgcgtctggaagataaatccgtcgcgctgctggcgatgaccggtaaacctcactctccgctggggcgagcggcaaaagccgttctggatatttccgtcgagcgtgaagcctgtccgatgcatctggcgccgacatccagtaccgtcaatacgctgatgatgggcgatgcgctggcgatggcggtcatgcaggcgcgcggttttaacgaagaagatttcgcccgttcgcatccggctggcgcactgggcgcgcgtttgctcaataatgtgcatcacctgatgcgccagggcgatgcaataccgcaggtgatgctcgccaccagcgtgatggatgccatgctggaacttagccgtaccgggctggggctggtggcggtttgcgatgagcaacatgttgtgaaaggcgtctttaccgacggcgacctgcgtcgctggctggtaggcggcggcgcgctcaccacgccagtaagcgaagccatgacgcccaacggtattacgctccaggcgcaaagccgcgccattgacgccaaagagctcctgatgaaacgcaaaattaccgccgcgccagtggtcgatgaaaacggcaaactcaccggcgccattaacctgcaggatttctaccaggcggggattatctaatccttcagtcccagacgcttcgccagccgatgcaggttggcgacgtcggtttccagcgcccgcgcactggccgcccagttgtgattattttgcgccagcgcctggcgaatcatctctcgctggaagttctccgtcgattcgcgcaaattgcggcaggccggcaacgccagaaagctttccgcagacggcgcgggtaaaacgtcctctgacaaggcaaaatgctgctcctccagtaccacctcatcccctgcccgggtcgctctcgccagtacaaccgcacggtgaatggcatgttccagctcccggacgttgcccggccagccatagttgagcaaatggcggcgcgcgccgggactcagtaccacgcgggacagccccagccgcagtcggcactgctcgcaaaaatagcccgccagcaacaccacatcatcgccgcgctcgcgcagcggcggcacaaagagcgggaaaacgctcaggcgatggaacaggtcggcgcgaaaacgccccgccagcacctcttcacgcaggtcacggttggtcgccgccaacacccgcacatccacgcgcaggctacgatcgtcgccgacgcgctgaatatcgccatactgcaacacgcgaagtagcttggcctgtagcgccagcgacagttcgccaatctcatccagaaacagcgtaccgttatccgccatttcaaacttaccgctacgattactgatagccccggtaaaagccccttttacatgaccaaacaactcgctctccgccacgctttccggcagcgcggcgcagttgagatagaccagcggattgaccgctctgggggagccctggtgaatagctttcgccaccagctctttaccggtccccgtttcaccgccgatcagcacgttaagatcggagcccgccacaatctcgatctcttttttcaactgcgtcatcgccggcgacagaccgatcatgtgcgtctcttttatcggttcaaacacgcctgacgaccccggcagcatgttctggctttccagttgttcaattaacagcgcattactcaatgccccggcggccagcgcggcgacaagccgtagttcttcatcgctaaatacctcgaactgctccggcgtcatagcatcaagggtcagcgcaccgatgaggttctgtccggcaaacagcggcagaccaacacaggcgtggactttcaggctttcctgtccgggaattaacccgtcatatggatcgggtaaatcgctatcagccggaaaacgcaccacgtcccccgcgcgggcgatggcttccaggcgcggatgcccttccagggtaaaacgtctgccgaggacgtcctgcgccaggccatcaatcgccagtggaataaattgtcgtgattcataacgcagcagcgccgaggcgtcgcacgccagcacctgacgcagcgtagtaatcagccgctgaaaacgatcctgatgcccaatgccgcgttgtaactcaatggcgatgcccgccaatacctccacggaaaaactcatggttacctcattgtcattttgacaatctatagtgtcatattgacagcatcatttatagtctttttgactataccaaaaatacaaaattattataatttcatataaatcaataagatgtaaagttggcacactacctgcaataagcaaaacaactttttgcaaacgttgaatgaattgaggtggttatgtctattctggttaaaaataatattcattgggttggccaacgcgactgggaagtacgtgattttcacggcactgaatacaaaacgctgcgtggcagcagctataacagctatctcattcgtgaagaaaagaatgtgctgatcgataccgtcgatcataagtttagccgtgagtttgtgcaaaatctgcgcagtgaaatcgacctcgcggacatcgactacatcatcattaaccatgccgaagaagaccatgcaggcgcgctgaccgaactgatggcgcagatcccggacacgcctatctactgtaccgccaacgccattgactctatcaacggccatcaccatcacccggaatggaattttaaggtggtgaaaaccggcgatacgctggatatcggcgacggcaagcagttgatcttcgtggaaacgccgatgctgcactggccggacagcatgatgacctatatgaccggcgacgcggtgttattcagcaacgacgcctttggtcagcactactgcgacgagcacctgttcaatgatgaagtggaccaaactgaactgtttgaacaatgccagcgctactacgccaatatcctgacgccgttcagccgtctggtaacgccaaaaattaccgaaatcctcggcttcaacctgccggtggatatgattgccacctcacacggcgtggtatggcgcgacaacccaacgcaaatcgtggagctgtatctgaaatgggcggcagattatcaggaagatcgtatcactattttctacgataccatgtcgaacaatactcgcatgatggcggatgccatcgcacagggtatcaatgaagtggaccccaacgtggcggtcaaaatctttaacgtcgcccgcagcgataaaaatgaaatattgaccaacgtcttccgttcgaaaggcgtgctggtcggcacttctaccatgaacaacgtgatgatgccgaaaatcgctggtctggtggaagagatgaccggcctgcgctttcgcaacaaacgcgccagcgccttcggttctcatggctggagcggcggcgcggtggatcgactgtccacgcgcttacaggatgccggttttgaaatgtccctgagtctgaaagcgaaatggcgtccggatctggatgcgctggagttgtgccgtcagcatggtcgcgacatcgcccgtcagtgggcgcttgctccgctgccggaaaccacacagaaaaccgcgccagtcgaagaaaccacaacctgcaccgccgcagacctcggccccaaaatgcaatgcagcgtatgccagtggatttacgaccctgcgctgggcgagccgttgcaggatgtcgcgccgggtacgccgtggagcgacgtgccggataacttcctgtgcccggaatgttcattaggtaaagacgtgttcgacgtactggcgacggaggcaaaatgagtcgggggatcatcattattgggtcgggcttcgccgcccgccagctcgtcaaaaatatccgtaaacaagatgcgcatgtgccgttaactctgattgcggcggacagcatggatgagtacaacaagcccgatctcagccacgttatcagccagtcgcagcgcgccgatgatctcacccgccagttagcgggggaatttgctgaacagtttaatctacgactgttcccgcatacctgggttactgacattgatgccgatgcccatgtggtgaaaagtcaggataagcagtggcagtacgacaagctggtactgacgaccggggcgacagcctttgtgccgccgattgcaggacgtgagttaatgcttactttgaatagccagcaggagtaccgcgcctgtgagacaccactgcgcgacgcgcagcgagtgctgattgtcggcggcggtctcattggcagtgaattagcaatggatttctgccgcgccgggaaaacggtaacgctgatggataacgccgccagccttctcgcctcactgatgccaccggaagtgagcagtcgcttacagcatcacctgaccgatatgggggtgcatctgctgctgaaatcgcagttgcaaaaactggagaaaaccgaagccggtatccgcgctacgctggtaagccagcatagtattgaggtcgatgcggtgattgccgccaccggcttacgcccggagaccgctctggcgcgccgcgccggggtagccgtcaaccgcggcgtctgcgtggatagctatctacagaccagtcacccggatatttatgcgatcggcgattgcgcggaaatcaatggtcaggtgctgcccttcctgcaaccgatccagttaagcgcgatgtacctggcgaaaaatctgctcggcggcaacgcgccgctgaagctaccggcgatgctggtcaaagtcaaaacgccggaactgccgctgcatctggcgggagaaactcagcgccgcgatttaagctggcagattaccgcagaatctgacggtatgattgccaaaggcatgagtggagaaggccagctacgcgcctttgtggtgagtgaagaccgcatgaaagaggcctttgcactgctgaaaacgttgtcggtataagcctgtgatgccggatagcgccgcttcgcgtcttatccggcctacgagtgagcatctgtttacacgccggataaggcgcagccgccatccggcgccctacacttcccttaacgctcgcgctgcggcaatcacgccctgtccaaacgacagtccgccgtcgcccgccggtaaccgctgcggaaataacaatttaaaatcagaaagataaaaggcaagacgcgcgcgcagtaagcggttgtgtatcaccccgccgctgaagaccagagtggttatcccccgcgccgtagcctgttggcgcattagcgtggcaaacccgcacgccagcgcatcatgaaaagcccaggcgcgttgcgcgggcgtggcctgccagttcaaccattgccgccagaaaacagcgacgtccagttgagcgccgttaagcggcatcgttaccggatactcaacgttagcgcattgagaggccagcgcctccagcgcgcaggcggcctcgccctcatagctaagcgatgctggcgcgcagcgaagcgcggcagccaccgcgtcaaacaaccgcccgcaggaagaggccaacggggcattgacgccgcgctcaatggcgcgcgccaggacactccagttttgctgttgcagccccgctgtctccgggtaattctgccagtccggcacaaagcgcaggcactgcgctaacagattacgccacggctgtttggcagccagatcgcctcccggcagcgccacggcgggtaaaccgcctaaatgttcgcattcgcgataattgacccgcaaacattctccgccccatagcgcgccattctcacccatgccgataccgtctaccgtcagggcaatcacctctccgccgtccagcggccaaccatgctcggccaggcaagccgccgcatgggcatgatggtgtaacaccgtctctgtcggcagacgcatctcactggcccactgactggaaacatagcccggatgcgcatcacagacgatacgctctggcgtaaaatcgtagattgactggatcaaacgcaatgcctcgcgccactgcgcctggataccgtcatcgctgagatcgcctaaatgttggctgacaaccgcctgttcgccgcgtaccagacagaacgtgtttttcagatccgcgcccagacaaagtatcggcggcacatcgcgaaatccgggcggcaacgcaatcgcgtccggcacgtatccccgcgaacgacgcagcatttcgccgctgtcgcgcacgacagagtcgtccatgcgctgtacaatgtcgcgattgtgcaacagaaaaccatcggcaatatcgtgtaaatcgtccagcgcctgttcgttggtgatggcgggcggtttgccgctcaggttgccggatgtcatcaccagcgggtaattgagtgcctgcaacaagagatgttgcaatgggttggctggcagcatcacgcccacttccgtaagtcctggcgcgatgccctcactcagcgaaggtacatactgcttatccaccagtacaatcggggccgctggcgtggtcagcagcgaacgcgccgcggtcggcagcgtttgcgccgtgggcaacatcaccgccaatggtttcgccggacgatgtttacgcgcccgcagcatcgccactgcgttatcgttgcgcgcgtcgcaggccagatgaaaaccacccagccctttaacggcaataatgcctccggcgttcagttgggcgaccgccgcctgcaaagccgcctctttttccgctcgttcatgttggctccgccactcaagatgcggcccgcatgacggacaggcaacgggctgggcatgaaaacggcgatcgtacggatcgcggtattcgctgtcgcattccggacacaagggaaacgccgccatcaccgtaaatggccggtcatagggcatagcgcgaataatggtgaagcgtggtccgcagtgggtgcaattgatgaaaggataacggtagcgccgctcgcctggggtattcatctcggcaagacatgccgggcaggtcgccgcatccggcacgatttgcgtgttcatcgaaccgcctgcgctctgacgaatggtgaaatccgtcggtgcgcgctcccataccaacgacgcgtgttcaacgctgtcaatgcgcgccagcggcgggcaatcctgatagagcgcggcaataaattgcgacggatcttccagcagccgaacgacgacgccgtcgccgtcattacacacgtcgccgtgtaattgcaactgctgcgccagctgccagacaaaaggacgaaaaccgacgccctgtactttgccccgaatgcgtagctgtacgccggaaggtgtgtctatcgccatcttattttcccgccatcatcgaacccggatgcctgatggcgcgacgcttatcaggcctacaaccgcacggaccgtagaccggataaggcattgatgccgccatccggcaatgctttgtggcgtattctacgcgcaatcgcagaaatcagaaaagcagcgatgccgttgaatccagcgccgcacgacggcgtttttccgcgctcagctgttcaagcttattgcggtccacgcagatgagggcgtgcgttgggcaagcggccatacaggccggaccggcttcacggtggtgacacagatcgcacttgttggcttcggctttttcggcacgcacgtttagccccgcgccgctattgcgaaccaccggacgaaccaccacttccatggcgccgtaaggacatgccactacgcaagttttacagccaatgcagcgttcctgcatcacatgaacaaagcctttgtcacggctgatggcaccattcgggcaaacgttggcgcacggcgcatcttcacactggcgacacagcgttgccgtggaaacgttcacgcctttgataacatggatacgaggtaaaaaggtttcaggggtcagcgatgcgcaatcctgattttcctgatgggatacgacgcaagccacttcacaggtacggcaaccaatgcacttactcgcgtctgcaatgatgaaacggttcatcaaattctccagcaataacagatgatgtgccgatatatacacgaatcgtgccaatttttatttcattgttatttaagaatattctttctattttcgtgagcatttacgtgtcatcgtcacaagtgtcgatgacacgtaatgtcgccagtggtggtcaagatttgcagtgatagccagccaactctgcacagaaactggcatcaatcctgattaacgcctggcaatacgttaccgcgtattaaacagcgctgcgtaagggaaagatcgtccgtttgcggattccttccggcaataggtttgataattaatttacggccaggatagtgattaaagcgggtcagcgccggataactcaaccggccaaaccagccgtgtacgcgctgccagcgggcgtccttcacctgatataaattggttatccagtagcctgagtcaaactgcatatccaacagttgcgtgcgaccattgccctgtaaatcaagcaaatcatcgacgccagtatcggtggcggtataaaacccccacggttcaaagacgcaggggcggccattcttgagaaaggtgaaaatgatgtattgcgcgctcggcgccaggcccaacccaggattgcccaaccagataaccaagtcctgaatgccgttacgatcgaggtcagcgcgataaaattgcgcattacccgccaaattaatcagccttcccaccgggacaacccacgaattaccggctctgtcttttccgctaatccgccattcgttatcttttttcggctccggcagtagcgtcacgctactgactccgacctggcgaaaatgccaggtctggtcgggcgatacagaataaggcaggatcaaaagcggcttcagcgcacgcttttgcgcatattcaccgtcgctcatcggcaggtaaccgacaacaccggtagccagtgcgcgtgcggcgaggcagagaaatagcagtccgctccatacgataatcttcacgttcttcttaccgcctatgccgggtaacacaaatccatccagaatgagtacgcattttacgcctccggcgcgtccagcgcggcaaatccgccgtttccctgccagccttccaggcgctgatagacgatgtttaccgcgtccttaatcggttgagtcatcggataataaaacccgacgatatccggctggataccaacaaaaatcacctcgccgacatcctctttcagcagatcgataaggtagttcagcggcatattgtgggtggtcatcataaacatttcggcgatatcatccggatcgatgatgcggatctcgcccggattaagtcccatatcggtggcgtcgacaatcaacagacgctgcgggcgcagttcgcgaatcgccacaatgtcgttttccggcgcgctgccgccatcgatgacaacccagttgcccttcggctgcgccgcgcacatttccgccagtaatgggcctgcgccgtcgtcgcccatcatgctgttgccgacacagagtaaaacgtcagtcacgaagcctcctcaccatcaggtagatggcgctttcctgatgaatgtcatgcagcatactgagcatcagtttgctccattcttgctgctgcggggtctgcgcggcgcgcgcctcatcaaacgcgcgcgccagcatttgcacatggttgaaatcgatgacgatctcgccatacttcggcacgccttccattttacgccgggcatcgctaccggcttccagggtggcgatccacgccagatactcatcccatgggcaggtgagcgcggcctccaggcaatcgataacccccaggtggtgaccaatcgccaggctgtaatagacaacctgctgcgcctcggcgggcgtcgcatcgttctcatcaataaacttacggctcagttgactgaacaccacctgttcgctcatcggatacgcgcctcttcaacaacatgattgagatggatgacaatttcggttaaacgcggatcgttttccgcttccagccaacgcgccacttgctgctcgccctgccccaactgtgtcaggtaatcatcggcgatctgacgaccatagcgataacccgccagccggcacgccgcgcgatccaccttcacgcgcagcggctgcaccatatccggatgcaggatctctgcgggctgatcgtccagctcacccggcgcgcgggcgtggattttctgctccagcaggccaagcgccattgcaaagccatacagcgtggcggcaggcgttggcgggcagcctggaatgtacacatccaccgggacgattttgtcggtaccgccccagacgcagtacagatcatggaagatgccgccgctgttgccgcaggcgccgtaagagatacaaattttcgggtccggcgccgactgccaggcgcgcagcgccggagagcgcatggcgcgggtcaccacgccggtaaacagcagaatatcggcatgacgcggcgacggtactactttgatgccgaaacgctcggcatcaaacagcggcgaaagcgtcgcaaagatttcgatttcacagccgttacagccgccgcagtccacgcggtaaacgtatgccgaacgcttaatatttttcagtagagacgccttcatgctggcgatggattcatccaccgtcatcggtaccggaatgccgttggcgtcacgcgggcctaataaattgctcattagctgacctctttcatatggcgagtcagttcaatacggtcggacggcaccaggcatttctgacgcttacagtccgggcaggtctcaaagctttcgcggtggttttctgctcggctgtcgccgttgtgcgcaagcagcgcaatggcgtagtcgatctctttctgtaccgcgaaaggacgattgcacacgcggcagttgcacagcgcgaagcgggactgttgcaggaagtcttctttcttccacactgccagttcgtactcttgcgacagtttgatcgccgccgtcgggcacacctcttcgcagcgaccgcagaagatgcagcggccaagattgaactgccacgccagctcattggtcgcaagatcggtttccaccgtcagcgcgttcgacgggcaggcattaacgcaggcggcgcagccgatgcactgctgcggattatgttccggcttgccgcggaagtttttatcaaccgcaatcggctccagcggataagacgaggtcgccgtgccggttttgataacttttttgataaaggtaaacatggcgattccttatttcagcggcgagtttttacgctcaatgctgtagcgctcaagttctttgtacggcacgactttgctcttcttcttacgtacatcgaccacggtcatccggtcggtacaggagtagcaaggatcgaggctaccgatgatcagcggcgcgtcggagacggtgttgccacgcagcatataacgcagggtcggccagttggcgtaggttgccgcacggcagcgccagcggtaaagcttctggttgtcgccggtcatgctccagtggatatcgtcaccacgcggcgcttcagcgaagccgagcgcaaaacggtgcggaatataggtaaagccttccaccatcagcgggccgcccggtagattatccagaccgaaatcgatcatattcagcgaggtgtagacttcgttgatacggactttcagacgagaaatcacgtcgcagccctgctcgctatgtacttccatcggcagcagaccgtagccgacaaacgggtggtcggcgcgggtgtcgcgggcgtgaccgctggcgcgcaccatcgggccgacattactgaagtcgcgggcaatttccgggtccagacggccgatacccacggtacgctgttccatattcggcgtgctcagcagcatgtccaccagctcctgcacgtcacgacgcatctgctgcgccagttgacgggtctggatcatgtcctctttgagcagatcgcggcgaatcccgccgatcaggttcagaccgtaagttttgcgcgccccggtcagtatttccgccatcttcatggaggtttcacgcacgcggaagaactgcataaagccggagtcaaagccggtaaagtggcaggcgaggcctaggttcagcaggtgcgagtgcagacgctccacttccagcagaatggcgcggatcatctgcgcacgctccggcacctgaatgcccatcgcgttttccacggaagtggtgtaggcagtgctgtgcgcgaaaccgcagattccacacacgcgatccgacaggaaggtgacttcgttataacccatgcgggtttccgccagtttttccataccacggtggacgtagaacaggcggtagtcggcatcgataatgttttcgccatcgacgaacagacggaagtggcccggttcatcggaagtgacatgcagcgggccaatcggcaccacgttatttttcttgtcacccagctcgttaatgaactcgtaggtttccgcatcggtggtcggcgccgggcgctgacgataatccatgctgtctttacgcagcggatagagttcatccggccagtcgtccggcagcaccagacggcgctcgtccggcagaccgaccgggattaaaccgtacatgtcgcgtacttcgcgctcaccccacacggcagccggcacgcgcggcgtaacggatgggaattccagcttattggcatccacttcaacacggacggtaatccagcacttggtgccctgctccatcgacagcacgtaataaacggcatagtggccgcacaactggcgttcgtcattaccgaacagcaccgacagccacccaccctgctggtagtaaagaaactccaccacttccggcagatagttcacttttaccgtaatagtcagctgatctttggtctgccaggcttcgtccatcacgacgcccggaaacgcctggtgcagcgccgcaaggtattgttgacctaatttttcttcaaacatgctcaaactctcttaaatcacgccgccagcaaggagacgaaggctaaaaacgcaaacccaaaaccggcccaggtcacgcgtgaagtggcgcaaaaacgcagtcgcgccatgctgttttcaaacagggcgatcaccagtacgccgacaatcagcttgacgacggcaatcaccagcgccagtaacagtccgcctgcgctgaaggtttccatctgtccccacggcaaaaacacgccgacgaacatttgcagcaccaccagttgtttcaggctgatgccccatttcagcaccgcaaagccgctaccgctgtattcggtcaacggcccttcctgcaactcctgctccgcttccgccaggtcgaacggcagcttgcccatttcgataaaggtggcaaaggcgcaggcgcacagcgccagaatcagcggaatactgcgcgcgacaggccagtgataaatggtatcggcgatattgctgatatgagttgaacccgccacctgcgcggctacccacagacccagcagcagaatcggctccaccagcacgccgagcatcgcttcacggctggcgccgatcgcagtgaacggactgccggtatccaggcctgcaatagagaagaagaagcgcgcaatcgcgaacagataaatcagggtgattaaatcacccagttgcggcaacggagatccaacggtgacgaccggcagcgcggtggcgatagtcagcatcacgccgaccatcacaaacggcgtcaggcgaaaaacccagccggaatcagcgggcgcaatactctgacgaccgagcagtttgataatgtcgcggtactcctgcaacacgcccggcccacggcgattgtgtagacgggcgcgcgccacgcgagtaataccggacagcaatggcgcaacggcaaatagcaccagcgcctgaattaacggataaaacacactcattttcaggctcctcgtgaaaccacaatcaccaccagcaccgccagctcaatcagcgccagacgacggaacagccccgcggccgccgcgttctgccagcccggcaccagcgataccgggttcagccatttacgcagtttgagtaccggggcaaaggcctctttcaccggcatggcgaaaccgtgcgcggtaatcaccatcgactgctcatggtcgtagccgcacacccaggccgcgccgcgagaacgcgacggcagacggttgcctttgaacatcgccataatgatgaatggcagtagcggacaggcgaccaacagcagcgtgatcatcggctgcgatacggtggtgtgcgcggtttccagcggcaacggtaccgcagtggaaatcatcggcagcagccacggcgcggcaaccccgcccagtacgcagcaaaccgccaatgccaccacgctgacgcccatcaggatcggcgcgcagctggcattttcagcttccttcgtgcgcggcgcgccaaggaacgtcacgccgtaaactttcgccatacacatcaccgccagcgcgccggtaatcgccaggccaaccgccagcagcggtcctaacagacgaccaacaaacgcgccgctgttgcccagtttgaagaaggactggtaaatcacccactcgccggcaaagccgttcagcggcggcagcgccgccatcgccatcagaccgaccagcatggcgatagaaataaccggcatccgtttaccaataccgcccagtttttcgatgtcgcgatgaccggtacggaaccagatgctgcccgcgcccagtaacagcacgcttttgaacaggctatggttcagcagatgatagagcccgccggtcagacccagcgcgatcagtaccggctgattgagagcaatcccggtaacgcctgcgcccagaccgagcaaaatgatgccgatattttccagcgtgtgataggccagcaggcgctgaatgttatgctccatcagcgcgtacagaccgccgacaaaggcggtgatcatcccaagcaccaacagcgccacgccccaccacagtggcgcattgccgccaagcagagatagcgagagaatgcccagcagcccgattttcatcaccacggtcgagaacagcgcggcggcgggagcgctggcgttggcgtgcgcctgcggcacccaaccgtgtagcgggataatcccggccagcagaccaaaaccgataacgccgagcagccagatatcggagcccagcggcagttgctgagcgcgttgatccagcagccccagatccagcgtgccgtagcgctgccacaccagccagcaggcgattgccagcagcagcgtaccgagacggcccagcgcaaaccacagtttgccctctttgctaccgccggtaaggaacacggcgcagagcgccatgatttcagccatcaccaccatcgtccccagattactggcgaccacagcgcagacggctgccgccatcagcaggttgatcaacagtccgttggcttttacctgtggatggcgatgccagtcgatattgaacaggctgacgaacagaccgcacagccccagcgtaatcagccagatagcattcagcggcgtaatttgcagcatgtgaccggtaaacggcatcacgccgctaaccgtaacggcgctggtcagcgcggtgaaccccgcgcctgccgtacacaggctgccgaccgcgccgccgataccggcaatccagccgctcagcgctttatgaaacgaaaacagaaacgccagaacggcggcggcggcaaaccacgcgacgccgctagtaatcagtgaaagtgaactcattatgcatccccactctgagcctgctgaaacaaggtgagatcgccaaaatcggtattaaacgtcagctcacgtttacgtttgctggcgcgggcgatatccgtgttctccaccaggtgtagcgctttagtcgggcacatccgcacacaggccgggccttgctcgtcaaagctgcacaggtcgcatttcaccgcgatagcgcgcacgcccggcacccagtcgagcaacgtactgacgcgcgcaggcgctggcggcgcgggcggcgctttcggcgtattggcgttcgccggaatatgcagcggacggctgccggaaaactcaatagcgccaaacggacaggcaataccgcacagtttgcagctcacgcacaggctttcattaagctggacagcgccgtcaacgcgattaatcgcgttaaccgggcataccgtggcgcatggcgcatcttcacagtggtgacagagctgcggcgcagattctttttcattcagcatcactttcaggcgcggcattgactgcaggccatgctggcgatgcgtctctgaacaggcggcctcacaggtgtggcagccgatacagagagtggagtcagcaattacaaaacgattcaccaggcattcctcaggtgattgtcatttttgacgaaaacatgccgttgaaatgtcattttcgacacttatcgacacgcccatccccaaaacattcatgacatggcgcaacgccacatcgcgaatcaaagcgggcaacgcctcaggcttatacagccgggctgtgtccctttaccaattggcgcaaattaaccggcgagttggtttctacagcggtatagaggctgtcgtaaacgctggcgattttttccagatagtgctccagcacctgctcgcgatcgcggttgttaacccgttcgtcaaccttgccgtcgatatcgagctgcgcctgtgcaatcaattgcttatcttcgccatctttggtttcaacgtagtactcaatggtgtggctgttaaaaccatccgccaacgcaacgtaaatacgaaagtgctcaaacaggacaaagcaaagatccctttccggcgcgcagctcattgcgtgatgcaggcgcgctttcgagagggtgatcccctgaaccagcgagttgcagtaaatatgccactggtcctgtaggcgacgatgccgttgcgcgatgtaatcggccttttcgcttatttcccaaatagtcatgtcaggttacccgtttaacagagatgcctgcgttaagcattttccatgccaatttttaacttattgtttttaatggaagacgcgcacagttactgccgtttcgacgcggtgacgacatgtcatttcgtcatcgtcgacattaacctgccaggggatacaaatattggcataaatattgctttacaggggcaaccactacgggaggcgatatgcacgaaatcaccctctgccaacgggcactggaattgattgaacaacaggcttcagcatacggtgcaaaacgtgtgacagccgtctggatcaaaattggcgcattttcttgcgtggaaaccagcgctctttccttttgttttgatctggtatgccgcggcacgatagcagaaggttgtaaactgcacctcgaagaacaggaagccgaatgctggtgtgagcattgtcaacaatatgtcacgttgttaacccaccgtgtacgtcgttgtccgcaatgtcatagcgatacgctgcgaattgtggccgatgacggcttacaaattcggcgcatagagattgatgaaactgaagattaatgccggataagatgttcgcgtcgccatccggcagaaagcctgtaacaagaagaagatcaggagtaagcgatgtgtacgacttgcggttgcgctgaaggcaacctttatatagaaggcgatgaacataatccgcactcagcgtttcgtagcgcgccctttgccccagcggctcgcccggcgctgaatattaccggcattaaaacgcctgactttaccccaagtcagaccgcagaaggcgatctgcattacggccacggcgaagccggaacccacgcgcctggtatgagtcagcggcggatgctggaggttgaaatcgacgtgctggacaaaaataatcgtctggctgagcgcaaccgcgcccgtttcgccgcccgccagcaactggtgctcaacctggtgtccagccccgggtccggtaaaaccactctgctgaccgaaacgctgatgaaattgaaagaccgtgtaccgtgcgcggtgattgaaggcgaccagcagacagtgaacgacgccgcccgcatccgcgctaccggcacgcccgccattcaggtcaacaccggtaaaggctgccatcttgacgcgcaaatgatcgccgacgccgcgccgcgcctgccgctggatgaccacggtattctgtttatcgaaaacgtcggaaatcttgtctgcccggccagcttcgatctgggcgaaaagcataaagtcgcagtgctttccgtgaccgaaggtgaagataagccgctgaagtatccccatatgtttgccgcggcgtcgctcatgctgctcaataaagtcgatctgctgccctacctcaattttgacgttgagaagtgcatcgccagcgcgcgtgaagtgaacccggagattgaaattatcctgatttccgccaccagcggcgaaggcatggatcagtggctggcctggctggaggcgcagcgatgtgcataggcgttccgggtcaaatccgcgccattgacggcaatcaggcaaaagttgacgtctgcggcattcagcgcgacgtcgatctcacattagtcggcagttgtgatgaaaacggtcagccgcgtctgggtcagtgggtgctggttcatgtcggattcgccatgagcgtcattaacgaagcggaagcgcgcgacacgctcgacgcgctacaaaatatgtttgatgttgagccggacgtcggcgcactgctgtatggtgaggagagataatgcgttttgttgacgagtaccgtgcgccggaacaggtaatgcagctcattgaacacctgcgtgaacgcgccgcccttcttccttacactgctgaacgaccgctgcgcattatggaagtctgcgggggtcatacccacgcgatttttaaatttggtctcgatcagttactgcccgaaaacgtggagtttattcacggccccggttgtccggtctgcgtgctgccaatgggacgcatcgacagttgcgtggaaatcgccagccatccggaggtgattttctgcacctttggcgatgccatgcgcgtgccggggaaacagggttctctgttgcaggctaaagcgcgcggcgcggatgtgcgtattgtttattctccgatggacgcgctgaagctggcgcaggataacccgacccgcaaagtggtatttttcgggctgggctttgaaaccaccatgccgaccaccgccatcacgctacagcaggcaaaacagcgtgacgtgcgaaacttctactttttctgccagcacattacactgatcccgacgctgcgtagcctactggagcagccggacaacggcattgacgcctttcttgcgccaggccacgtcagcatggtcatcggcaccgaggcgtaccagtttatcgccgccgattttcatcgcccgctggtggtggctggattcgaaccgcttgatctactgcaaggcgtggtcatgctggttgagcagaaaatagcggccctaagccaggttgaaaaccaataccgtcgcgtggtgccggatgccggaaacatgctggcgcagcaggccatcgccgatgtgttctgcgttaatggcgacagcgagtggcgcggcctgggcgtgattgaatcctccggcgtccacctgacgccggagtatcagcgctttgacgccgaagcgcatttccgcccagcgccacagcaggtctatgacgatccgcgcgcccgctgcggcgaagtgctgaccggcagatgcaagccgcatcagtgcccgctatttggtaaaacatgtaatccagagaccgcgttcggcgcgctgatggtctcttccgaaggcgcatgcgccgcctggtatcagtatcgtcagcaggagtgtgaagtttgaacaatatacaactcgcccacggcagcggcggccaggctatgcaacagttgattaatagcctgtttatggaggcctttgccaacccgtggctggcggaacaagaagatcaggcgcgtctggagctggcgcaactgacggcggagggcgaccgtctggcgttttctaccgatagctatgtgatcgatccgctctttttccccggcggcaatatcggcaaactggcgatttgcggtacggcgaacgacgttgcggtgagcggcgcgatcccccgctatctctcctgcggctttatccttgaagaagggctgccgatggagacgttaaaaagcgtggtcaatagcatggcggcgaccgcacgggaagcgggtatcgccattgtaaccggcgacaccaaagttgtgcagcgcggcgcggcggataaattgtttatcaacactgccggcatgggggcgattcccgccgatattcactggggcgcgcaaacgctgagcgttggcgatgtgctgttagtcagcggtacgcttggcgatcacggcgccactatcctcaacctgcgtgagcaactgggactggatggcgagctggcgagcgactgcgcagtattaacgccgcttattcagacgttgcgtcatattgacggagtgaaggcattgcgtgacgccacgcgcggcggcgtgaatgcggtcgcccatgagtttgcggcgtcctgcggttacggtattgaattgtccgaatccgcactgccgctcaaacctgccgtgcgcggcgtctgcgagctgttggggctggatgccctgaactttgccaacgaaggaaaactggtgattgccgttgaacggcaggccgcagatcgggcgttggcggcattacgcgcgcatccgctgggacgtgatgcggcgctgattggcgaagtcgtggaacgcaaaggcgttcgcttagccggactctatggcgtgaagcgaacccttgatttgccacacgccgaaccattacctcgtatatgctagcagcctgttggcagcatactgtaggccggataagacgcatttgcggcgagatccggcattaacgctgcattaacgcctgatggcgctttgcttatcaggcctacggagtgtgtgaccagcgagtttgcggtcagccatccggcaataacttacgacttatacctataattcatttaccgttttcgcaccgttttgcggtattttcctggaaaagcaacatgtcgtatacacccatgagcgatcttggacagcaaggcttgttcgatatcactcgtaccttattgcagcagcccgatttggcgtcgctcagtgaagcgctttcgcaactggtaaagcgttcagcgctcgccgacagcgccggcattgtgctatggcaggcgcagtcgcaacgcgcacaatattatgcgacgcgagaaaatggccgtcctgttgaatatgaagatgaaaccgtactggcgcacggcccggtacgtcgcatcctttctcgccccgatgcattgcactgtaatttccatgagtttaccgaaacctggccgcagcttgccgcgagcggcctctaccctgaatttggtcattactgtctgcttcctttagccgcggagggccgtattttcggcggctgcgaattcatccgtcaggaagatcgcccctggagtgaaaaggaatatgaccgtctgcatacgtttacccaaattgtcggcgtggtcgccgagcaaattcaaaaccgggtaaacaataatgtcgattatgatctgttgtgccgcgaacgcgataacttccgtattctggttgcgattaccaacgccgtcctgtcgcgtctggatattaatgagctggtaagcgaagtcgcaaaagagatccaccactatttcaatatcgacgcgatcagcatcgtgttgcgcagccatcgcaaaaataagctgaatatctactccactcactaccttgatgagcatcatccggcgcacgaacagagcgaagtcgacgaagccggcacgctcacggagcgcgtctttaaaagtaaagagatgctgcttatcaacctcaacgaacgcgatccgcttgccccctacgaacgaatgctgttcgatacctggggcaatcagatccagacgctttgcctgctgccgttgatgtccggcaagacgatgcttggcgtgctcaaactggcccagtgcgaagaaaaagtgtttaccaccgccaacctcaagctgctacgtcagattgccgaacgggtagccattgccgtggataatgcgctggcctatcaggaaatccaccgtctgaaggaacgcctggtcgacgaaaatctggcgctcacggagcagcttaataacgtcgacagcgagtttggcgagatcatcgggcgcagcgaagcgatgtacaacgtgctaaagcaggttgagatggtggcgcagagcgacagtaccgtgctgattctgggcgaaacgggaaccagtaaagagttgattgcccgcgccattcacaacctgagcggacgtagcgggcgcagaatggtaaagatgaactgcgccgcgatgccggcggggctgctggaaagcgatctgtttggtcatgagcgcggcgcgtttaccggcgccagcgcgcagcggattggccgtttcgagctggcggataaaagctcgctgtttctggatgaagtgggcgacatgccgctggagctacagcctaagctgctgcgcgtccttcaggagcaagagtttgaacgtctcggcagcaataaactgatccagaccgacgtgcggctgatcgccgcgactaaccgcgatctgaaaaaaatggtcgccgatcgcgaattccataacgatctctactatcggctgaatgtttttccgattcagcttcctccgttacgcgaacgtccggaagatattccactgctggtcaaagcgtttaccttcaaaatcgcccgccgaatggggcgtaatatcgacagcattcccgccgaaacgctgcgcacgctcagcggtatggaatggccggggaacgttcgcgaactggagaatgtcgtcgagcgcgccgtgctgctgacgcgcggcaatgtgctacaactgtcgctgccggatatgactgccgtaacgcccgatacctcgcctgttgcgactgaaagcgccaaagaaggcgaagatgaatatcagcttattatacgcgtgctgaaagagaccaatggcgtagtggctggaccaaaaggcgcggcgcagcgtctggggcttaaacgaacccccctgctgtcgcgtatgaagcgattgggtattgataaagacgcgttagcgtaacgggttgccggatctgatccggcctggagatgatgcgcgccgtaggcctggcgcttccccttcacttcttgcgctgatatttttccggcaattctggaacggggcgcttatcgtcgataaggtgccgcacggtcaggacaggatgccgccaaagcattcgcggacctgcccaacgcataatctgcttcatctcctcgcgtttagccggctgatagcagtgcaccgggcactgcttacaggcgggtttttcctcgccaaatacgcatttatcaagacgtttttgcgcgtaggcgaacagcgcgtcgtaatgcccctgcaccgctgacgcctgtggacactggctttcatacagcgcgatcatttttttgatcgtcagtttttcacgagcgatacgtttaccaggcatcgtgctctctccgaacattaagatgcatttattttacaccttatccctctttagcactatcactgcatatcgtcgccattacgcaaataagaattattttcatttattcatgccttgtgctatataacatagcaaaggctatattcgatgattaattaaccacattgttgcgagggatactatgacgaatctacatcgtctaaaaacactcctgattgccggtattgtcgcgatactcgcgctatcgccagcctatgcaaaagagaaatttaaagtcatcaccacgtttaccgttattgccgacatggcgaaaaacgtggcgggcgacgcagcggaagtcagctcgattaccaagcccggcgctgaaatccatgagtatcagccaacgcccggcgatattaaacgagcgcagggggcacagcttatcctcgcgaatggtctgaacctggagcgatggttcgcccgcttttatcagcacctttccggtgtaccggaagtcgtcgtctccaccggcgtcaaaccgatgggcattaccgaaggcccgtataacggtaaaccgaacccgcacgcctggatgtcggcagaaaacgcgctgatttatgtcgataacattcgcgacgccctggtgaagtacgatccggataatgcgcagatctataagcaaaatgccgaacgctataaagcgaaaattcgccagatggccgatccgttgcgtgccgagctggaaaaaattcccgccgatcagcgctggctggtcaccagtgaaggcgcgttctcttacctggcgcgcgataacgacatgaaagagctttatctctggccaattaacgccgatcaacaggggacgccaaaacaggtgcgtaaagtgattgataccattaaaaagcaccatattcccgccatctttagcgagagtacggtttccgataaacccgcccgccaggtcgcgcgtgaatccggcgcgcattatggcggcgtactgtatgtcgattctctgagcgccgctgacggccctgtgccaacctatctggatctgctgcgcgtcacgaccgaaaccatcgtcaacggcattaacgacggactgaggagtcaacaatgagtcaatctgcgattaccgttgatcaagtcacggtgacgtatcgcaacggtcataccgccctacgggacgctacttttcaggtgcctggcggttcaatcgccgcgctggtaggcgtaaatggttccggtaagtctacgttatttaaagcgttaatgggctttgtgcatcttgcgcggggcgatatcactatcctgcaacagtcagtcaaccaggcgctgaaaaaaaacctcattgcttatgttccacaatcggaagaagtggactggtcatttccggtactggtagaagatgtggtgatgatgggacgctacggtcatatgggctggctacgccgtcccacagcgcatgatcacgcctgtgttgacgccgcgctggcgcgggtggatatgcaggaatatcgtcacaggcagattggcgagctgtccggcgggcagaaaaaacgtgtgtttcttgccagggccatcgctcaggatggacaggtaatcctgctggatgaaccttttaccggcgtggatgtaaaaaccgaagcgcgaatcatcgatctactgcgggaactgcgcgatgaaggccgcacgatgctggtctcaacgcataatctcggctccgtcaccgaattttgcgactatacggtaatgattaaaggaaccgtactggccagcggccctaccgaaaccacgtttaccgccgcgaatctggaactggcgtttagcggcgttctacgtcatatcgcgctaagcggaggtgaagagcacatcatcaccgatgacgagcgcccctttatttcccgacgcgtggccagcggaggaaaatcgtcatgaactggcttgttgagccgtttggctaccagtatatgctcaacgcgatgtgggtctccgcgatggtgggcggtctttgcgcgtttctctcctgctatttgatgctcaaaggctggtcgctcattggcgatgcgctatctcactctattgtgcctggcgtcgctggcgcctggatgttagggctgcccttctcgctcggcgcgtttctttccggcggactggcggcaggcagtatgctctttcttaaccaacgctcacgcctgaaagaagacgcgattatcgggcttatcttctcctctttttttggcgtcggcctttttatggtgtcgctcaatccgatgtcggtgaatatccagacgattattctcggcaacgtgctggcgatcgcgccagcggatattacgcaactggcgattatcggcgcagtctcgctgacgattctgctgttaaagtggaaagatctgatggtcgtctttttcgatgagacccatgcgcgttctatcgggcttaatccgggtcgactaaaattgttgtttttcactctattgtccgtctctaccgtggcggccctgcaaaccgttggggcgttcctggtgatctgtctcgtcgtcacgccgggcgcgacggcctggttactcaccgaccgttttccacgtctgctcatgattgccgtcgtgattggcagcctgaccagttttctgggcgcatggcttagctactggctggatggcgccactggcggaattattgtcgtcatgcaaaccttactgttcatcacggcctttattttcgccccgaaacacggtctgttagccaaccgtcgacgcgcccgcctgcagaaggagccgacatgttcttagcaacgttactggaaccctttcagtttgattttatggtgaacgcccttatggtttcggtcattgtggcgattccctgcgccttgctgtccgtgtttttagtgttaaaaggctgggcgttaatgggcgacgcaatgagtcatgcggtattccccggggtcgtgctggcatatattgtggggattcccctggcgattggcgctttcattgccggattattttgcgctatcgccaccggttatctggacgataacagccgcatcaaacgtgatacggtgatgggcatcgtcttttccgggatgtttggcgcaggtctggtgctctatgtttctattcaatcggaagtgcatctggatcacatcctgtttggggatatgctgggcgtatcgctgggggatatcgtacaaacgtcggttattgcactgggtattgcgttaatcatagggctgaaatggaaagatctcctgctacacgcttttgacccgcaccaggcgaaagccagcgggctgaatacgacgctactgcattatggcctgctatgtatgattgcgctgactatcgtcgccacgctgaaatcggtgggcattattctgtcgatttcattgcttatcgcccccggcgcaattgccattttgctgacgcgacgctttgcgcgcgcgctgggattagcggtgagtctgtcagttattaccgcttttgcgggcgtctatctgtctttttatcttgatagcgcgccagcgccgaccatcgtggtattatttgccatcgtgtttattgcggtatttatttacgcaacatggcgcgacaggcgtaatgaaatcgtaccagaggcgcaaggttaacagcagcgttcagaaaataaatacgacagttgtagtagaaagccaccctatatctgttgttggtcagtatggtaagcagctatctttaaatttctttacaacaagcgtaaagataagctgctttactccccatgtttttcctgtttcgaaattttttcagagtttggctaacccagcataatgtgattattactcacaagatctgtaatatcccagcaaaaaataaatttataactacacgtaatacaagagagtgattgtcacataaaaaatagtttaattcattcctactgcaatcggtaacgcgcaattatcgtcaggtacagcagggttatgtgcaaaagcagtgcgctgtaaatgcgcgtctagtttcagtccccgaaacagagatagcggtgaagagtccatccccaaacgatacataaccttcttacgataaatactgacggtttttgttcccagaccaaattttttcgccagttcaattgccggatgtccggaggataataatatcagcagcgcatatttcgcctgcgtgacaccgggaggtagattccaccaggcgtattgattgatattaaacaatacctcttccggcgtctcgccggcattaaaagcatacgtagcagccacggttttcttttgtggcctgtggcagaaacgcagccaggcttccggaagacggagcttctctcgctccgagcggatagcgcaggatagttcgtcttttaaaacataatccataacgccaaaatattgcagcacacagcgatcgatataatacaagcgatctgccactaccaaaactttacggttctgcaaccgcgcctgcaacgcatgaaaaagataaacatgctcatgcgggttcaaagctaaaatcagcccggcgtccggcatatcggatagagaatgcaaaagtgcggttaatgagttacacgttttaacgcacttttccggatatttttgcttaaaaatagactgtagggcataacaattagtccagttaataccgtatataattacatttctcatttatttatccttttttgaaaactgaccacagcttcggtaatgatttttcttcctgggcgactactgcgcaagtagataacgccctcttactacaaaggtaataagaccagatacgttattacatgcgcaatgtcgttaccgaaatgaattccttttacaaatctgataatgattaaatttgctgttttactttactgtaatctcttagagtacaacgattgcctgacgccttgtggccatgtatgtctgacaatgaacgctttcggttccctttcattagctacatatcactggtgtagcgatactgaaatatacactacgattaaaaaaatatttggtatctgtaacgcaaacagatagtaacgtttaaaataatttcacaaatcaatggttcattgtacgcataaagctaagcggtgtaatcttaaaatgccgtttaaaaatagcgataaaataagaaggcgtatcatagccacacatcgtcgcgacttgtgaaatatttccagcacccatacgtaataattttatagcctgattcatacgagcatccaagtatattttgctaaaactcacctcttcagcggccagttttcgcttcagacttgatacgctcataaacagctttcctgccacctcagcctgtgaccatttgcgggtgagatcgctgataataatgttataaactttctcttttgttgtaatttttattgctcgctcaaggaaatcaaacccaccgggcttacgtacaaatgccgatataagatacatcaatgagaaatatgaataatcatgatcatcaatactcacattactacaaacccgtggacatgcgacaccatgcaaaatagagtcaaaagtatcactcatccctggcaacaagtccgcatgaaaaaaatactttggtttcgtttttaatgatagctctcgatcattatagtttcttgtactgtaaaaaactttgtagaatttttgcattaagtcataggaaacttccagtgaagaaaaatcaatatgtccttctatttcgctcatactaagcgtgattgtttgatctttttccaataaaaataaacacagcgcagattgttcgatgaactccccaaattcgttttcaattcgcaaactgcctttattaagtttaaacaataagcagtttgcgacataatagtctcttacgtcagctaatccatttattaatggaaatttgttcggttgttgaaggtgattattgctaatggcctcaactgatttattcattgaaggcaataccatattttatcctgtgtgctataaggaactcaaaatcgttatattcttataaacaaataattaaaactcacagagatgatttaaatccgatttttttattattatagccaataattacattccaaagcgcgttcatttcgtcacaaaaagatacccttacaaactttatgcacaattttgtaataaaagcttacaatattaatataatcctttcagaataaaacgcctggcagataccttaataatccatatacatcaataagatagatacactggcatggtgcattttctgcattatttgctgatatatacaccataccttatcacaaatcgccagcaatggggggttcaccagtcaattgcctctttgttttccccgcccgataaaataatctcctgcatccaggaggtcatttgtgactgtgcattcattgtaccaactaataccccgtttaaagcctcatataaatgggtgcccggttcaacttttgctaacatgttttgtagcatagccgtttgctgctcaaaagaaacaaaagccgaatcaccacttttaggatctttgaaggcattcatctcttgataaatgctatctttaagcgtttcagaagaggctgactcaggaagcgccaaaagtcgttggtagaatgcatcataaagatcaacgtcgccgccattgcttaaaggcgcgctatccacattattcagcatagcggccctggcactcaacgaaaccacacccgtcacttcagtatccgctgtcgggaccaaataagaagtcggaatcgtacccggtatcaccttataacctccattttacaatgcttgcgtttttgtcttccattcatcaataagtgcgttaatggcgttatcagaaatcgtccggcagtcttgtggaagttcatcaagatgatgcttaatgacgcctactgctgtttcaacaaattgttcaggtgaaaattctgcgatctgatcgccgcaactcatgataaagcgctgttcctgatgatatttaagattaaaagtgccaggccagttctccataagcaacaccatcagtttttggtgttcttttttcgcattaactggcagtgttaaaaaaagttgcccctccggcttatcgaaatcccttagccactcatccaggacggttaaaagcgtttcgggatggtcgaccgctgctgaaaataactcgcgggcataaatctgtattttttccatccacttccaggccattgtctgattatcagtaagataagcggcgacctgctgtaacgcgtctatcattccctgctcgtaaccttcctgataggcgtacatccgcaaggtctttgcctcttcttccgcctctcgcaaaatacgcttagcccgttggtgcgcctgctgttctaatctttcaatagagaaataacgttccagcgttttacgctttatcagtatcccctcaacaggcgaaagcggggacggaattgggatatttttgagcatattgtaaggccagtagcaaaattgacatttctacagcatcctgcttcaatgcctcctcaataaatggaggaaaaagcaaaggaaaacgctgtgctaaagattcaggtaaaaattcattcagggcatttaactgtgcatacccgacgctaagtaaaaacctgtgattcggcgccttattgcaaacggataaacttgttccctgatgcattgccaaaaatgcttgcgcccaatccggcaggccaagcaaggctccctgccttgccagatcggctctcagtttatggcaaccgagtaaatacgctacttgcggcagtcggcgccactgacgcagccacagctgcgtcagtgagttttgaatacactccttttctccgttcttaagccgccatgtcgccagtattaactcatttgccgccgccctggcggcgggtctgacaatcatttccggcgctatctgcaaccgctgaggatggatatacgataacggatcaaaaatgattctttgccagataatgggtaatggctgcctattcatttgacgatttcgccttatcatcagccgttatgcctttcttattgcgggcataatggtttttgtaataccagacgccagagcctgctgacatcacggataacaaaataatcaacacaatccaactggttgcaaaagaattacgttttactggtgtgccgggagcctgtaattgggcatcagaacgttctgacaacacaacagaaatgttgtcataatccacatcggcaaaactattctttaagaaacgcttgatatcgctgatctgatgcgcaagcggcgaacctcgttcatatacggctaatgccgacagatgaacaggttttggcggacggccattttcaccagcatcaatatcataactaatatggaccctggcggagagcacgccctccatcgtctgtaatgactgttccagtcgctgttcaatagccgaatataacctggccttttcagctcgcggagacgataccagcgaatccgccgggaacatctgcgctatttccacccgtggccggggaggaagctgataagttttaatccagtacaccgcagcggtaaaatcaggctcagcaacggtaatgctatagcccaattttccgctatcaattttattcgcctctatattgtgcatttgcagaacggcaatgacctcattagcctgttcctggtccagtccttttaaaagatccttatccttacagccggcaagggtcattaccagcagaaaggtatatagatatcgacgaatcatgagcgtaatagcgtttcaacagccccgactcctttacgagtaagggtacttaccatagaaacatacaggttataatctgaaatcatctcttgcgaaatagccagctcattaggatccgtcaccagattagggtcctcaatcctgttggtaatcgtctgtttatccacagccgtggcaatcgccgaaccagaaaaagcctggagtagccggtcatccagcgagacaatgtccgtttccataggcctgatattgaccgcctgccctataacggcattctcagggacaatagttgcaatcgacataatccaccttataactgattaacggaagttctgaataatggcagcatcaatatccttaaagacttttaccgtgttcgattgcgcgttacggtacaagttatattccgagagcttactctgatacgccgccagtagcgccggatcggagggttttgctgctaatttatccagcgcctctgttacctgcgtttgtagattatcaacgcccttatcaaattttgctgaaacttcatccagatagcctgaccaagatgttggcataatgacttccttatttgcgttaaattaaagtgggcttgggaaataccaatggcctgggctcattttgatataaccttccgccccgtactgaaatgagcgccccttgagccagtcatcttttaattcgatcgcaaactgcacatagcgtcctccccatgtgcggtaatagctatcgacaaattgacgggctctgagtatttctacatcatcgagcgccccctgaataacaaacgttacgccccccttatgattcctgcgggaataaggtaacgcctgctgttttagccccgcttccgcctggcctgcggcggtaacatcgtccatcaatgtgatgttaaccgaatccgcgtaaggcattagcgctctcagcttttgacttaacacctcgagctctttcttgctcatcgtgtttcgctggcggcttagccagaaaacgggtttacgcggctcatcgaaatgaagccgataataagccagctgcggataataggtatccagccaggtagagatacgcttattttcttcgttttcgttaatcactcgcgcatttttatcataatcgcccctcgctaaaacctgacgagcccacagcgtatctctttcattttgcgcagcgacatagagcattttgtcccgtcctggcaacacctgaaagcgctccttctcctgccccaataacgaatcgagctctgcggcctgccgctgcggcgagttaagtatccataacgtccccaccgtcccaattcccaatataaaaaacccggccagtgctgctacaattccgtttttaaaacgcggctcgttcttttttgcagacgtttctaacttctcaggctgctcgggcacccacggctcgctttccgggcgaatcaggataagcaattcaccgacctgtattggcgtatttaattgcaccgaacgagattcaggatttccttctttcagctcatggagtataatttcggtcgcatccgtatccacctggatttcaaaatttactccgccatggtccagcgggataaaaaagctatcggcaggtatatcagggagttggcctgaagcagtgagcgcatcactctgacctaccacaaagagtgttcggcctgtcagcaatggaaactcacagccgttcagtgagctgttaagtaatcgaactatgtatggccctgggcttgttatcgtcttctcttttgatgtttccatatatactgttagcgatatctgtcgttctcgatagcagcagattaccgcacaggacacagggattcctgatgaaaatagaatgaaaagtgagaaataaaatcaatttattctgtataatgcgtctcaacacatattaaaagaaccatcatccccattggggcttaaactactgtagataaattacccaaatttgggttcttttggtgtaacaatcagaccattgccaacacacgctaataaagagcatttacaactcagattttttcagtaggataccagtaaggaacattaaaataacatcaacaaagggataatatggaaaatgtaacctttgtaagtaatagtcatcagcgtcctgccgcagataacttacagaaattaaaatcacttttgacaaatacccagcagcaaattaaaagtcagactcagcaggttaccatcaaaaatctttatgtaagcagtttcactttagtttgctttcggagcggtaaactgacgattagcaataatcacgatacgatttactgtgacgaacctgggatgttggtgctcaaaaaagagcaggtagttaacgtgacgcttgaagaggtcaatggccacatggatttcgatatactcgagataccgacgcaacgacttggcgctctctatgcacttatcccaaacgagcagcaaaccaaaatggcggtacccacagagaaagcgcagaaaatcttctatacacctgactttcctgccagaagagaggtatttgaacatctgaaaacggcgttctcctgtacgaaggatacaagcaaaggttgcagtaattgtaacaacaaaagttgtattgaaaatgaagagttaattccttattttctgctgttcctgcttactgcttttctccgactccctgagagttatgagatcatccttagctcggctcagataacgttaaagaagcgcgtttacaacattatatcttcgtcacccagtagacagtggaagcttacggatgttgccgatcatatatttatgagtacgtcaacgctcaaacggaaacttgcagaagaaggtaccagctttagcgatatctacttatcggcaagaatgaatcaggcagcaaaacttttacgcataggcaaccataatgttaatgctgtagcattaaaatgtggttatgacagcacgtcctacttcattcaatgtttcaaaaaatattttaaaactacgccatcgacattcataaaaatggcgaaccattaacatttttgtatcagtcactcaagtaaagatttttattaaaattttaataatttaaaattcagaccgtgcattaacacgctatatcaggatgggaggctattcaacatcattgttctgtccggaagacagcttatactgatatctctggtaatttaaagtaaggctgattatataacacgatttttgtgaacttgtcatcgctatgatgactggtaaaccgatattgccttattcacagcgtaagaatccgtccagatgacactatctccttccggctttaaccctatggattaaggccggcattttattcatatttatacatcatccgttccctctgagaactatttgcctgaacggtctacaccgaaacagtcacgcttgttagctttctgccaggcatacatcttctcttcatcctgatatcgatataatgcctgggggccagcttgaggatgatactgctcataaacccctgcctttttgacgctatagctgaaggagtaaagaaaagacgatatcattattttgcaaaaaaatataaaaataagcgcaccattaaaaacagtcttgcatttatattttggcacctaagacaaattacactcttaaactttcaacgaatggtcatttagtggaaatcttcgagaaaaatggttctgatggtgtaattatcagaccattaaccatgaagatataataagcagcatttacacccccaaaaaatgcagtaagatagctacaaaactaatctctattgcaatgagaccaagttaaatatgtaaatatttagatgcccggcgctgactctcggcaccaggatatacgacagcgtccattcgacaatcacggttagttataacaatatcattaccaacatgtcagttatttaaagcacaggcataagctaaataatcaaatgttaaaaacatataaacccgagcccgtacaatatgacattaagctcataataaaagctcaacctgaccgttagtactagcagcagaattactgaaacagtagattctatcctaacgacttgtattagctattataacttttcaccctgtaagagaatacactattatcatgccacattttaatcctgttcctgtatcgaataaaaaattcgtctttgatgatttcatactcaacatggacggctccctgctacgctcagaaaagaaagtcaatattccgccaaaagaatatgccgttctggtcatcctgctcgaagccgccggcaagattgtgagtaaaaacaccttattggaccaagtatggggcgacgcggaagttaacgaagaatctcttacccgctgtatctatgccttacgacgtattctgtcggaagataaagagcatcgttacattgaaacactgtacggacagggttatcggtttaatcgtccggtcgtagtggtgtctccgccagcgccgcaacctacgactcatacattggcgatacttccttttcagatgcaggatcaggttcaatccgagagtctgcattactctatcgtgaagggattatcgcagtatgcgccctttggcctgagcgtgctgccggtgaccattacgaagaactgccgcagtgttaaggatattcttgagctcatggatcaattacgccccgattattatatctccgggcagatgatacccgatggtaatgataatattgtacagatcgagatagttcgggttaaaggttatcacctgctgcaccaggaaagcattaagttgatagaacaccaacccgcttctctcttgcaaaacaaaattgcgaatcttttgctcagatgtattcccggacttcgctgggacacaaagcaaattagcgagctaaattcgattgacagtaccatggtctacttacgcggtaagcatgagttaaatcaatacaccccctatagcttacagcaagcgcttaaattgctgactcaatgcgttaatatgtcgccaaacagcattgcgccttactgtgcgctggcagaatgctacctcagcatggcgcaaatggggatttttgataaacaaaacgcaatgatcaaagctaaagaacatgcgattaaggcgacagagctggaccacaataatccacaagctttaggattactggggctaattaatacgattcactcagaatacatcgtcgggagtttgctattcaaacaagctaacttactttcgcccatttctgcagatattaaatattattatggctggaatcttttcatggctggtcagttggaggaggccttacaaacgattaacgagtgtttaaaattggacccaacgcgcgcagccgcagggatcactaagctgtggattacctattatcataccggtattgatgatgctatacgtttaggcgatgaattacgctcacaacacctgcaggataatccaatattattaagtatgcaggttatgtttctttcgcttaaaggtaaacatgaactggcacgaaaattaactaaagaaatatccacgcaggaaataacaggacttattgctgttaatcttctttacgctgaatattgtcagaatagtgagcgtgccttaccgacgataagagaatttctggaaagtgaacagcgtatagataataatccgggattattaccgttagtgctggttgcccacggcgaagctattgccgagaaaatgtggaataaatttaaaaacgaagacaatatttggttcaaaagatggaaacaggatccccgcttgattaaattacggtaaaatctgagagaggagatatgcattatttttttatcatcgtaatctggttgcttagcataaatacggcatgggctgattgctggcttcaggctgaaaaaatgttcaatattgaatccgaactactttacgctatcgcccagcaggaatcggcgatgaaacctggcgccattggtcataaccgagatggttcaaccgatcttggcctgatgcaaattaacagcttccatatgaaaaggctgaaaaaaatggggattagtgaaaaacagttgttacaggatccctgcatttctgtcattgtgggcgcatccattttatcagatatgatgaaaatctacggttttagctgggaggccgttggcgcttataatgccgggacgtcgccgaaacgatcggatataaggaaacgttatgctaaaaaaatttgggagaattacagaaaattaaaagagatgtcagcagaagagaaaaacaaaagactttctatcgcggtaaacaaataattatacaggaatagcttactttcagataattctaaaagtaagctatgtttttatcagcttgccgtcgtcataagcaactgggcttgcattgcttttagttgtacaaactgtgaggcgtcttccagcattctattgttccgtgaattccggaaatctgcacgtacctgctccagattactatgaggattatccttaagtacaagagccgccgccatcgttccggttcttcccactccgcccagacaatgaatcatcggtaaatgcttatctgatgaactacgccccggcgcgccattttggttactatttttcaccctatccgccaggtattctaactgatcagtagacggtaacggctggtgatctggccaatttttcacatgcaataccgggattgtataccgcttttccccgcaggacagttgcatattgtattggtctatcgctcctccctgactggctgagctcactttttggctgttggtatgcacctcgccaaaggtgtagctccctctgaaataggctggtaattgttttgcctgcatctgatcttccgacgttaacaccaccaggcacgaacattctttttcaagaagcattttcatatgcgcttccagcgcatccggcgtattttttgggcacgaaccggctaatgccacaggcttaccgtcaaaagttaacgtattcactggcacaggcattccatcgctcagtttcacctgggtttgctgattaatgggaatgctgctgaccgcaaaccgtgccaggcccagtgtcggtccgctcatcgtctgtggcattgacgcaccggcttttattttctcaagttcagctgtaacgtttttcagttctttagcaataacgtgaattttttttaccgcttgggttaattcatgagtagaggctttatcaatccacctctcaacctctcccccacaggttccccattgtgagaacctgtctgctcctatctgaatattttttaacgttgtaacataatcattaagttgtttagcctctggaattttatttaaactctgtaaattcgtcattaatgaacgcagcgggccgttacctgaagccatctcctggaagttttctcgcaggctatttccatccatttgttccagttgcggtattgttctcttaagtccctttagcgcgatatcgagtaaaggttgcttactttctgcaccaacatcgttattttgttctgtcacttttgtatcgccgccttttatgactaaagcggcattcatgacaccaacattatccttgttcttaataagatttataaaccctccgtcagcaccttttacacactccgtgatctgcactactaaacgttgggtaaggggtttgttcatatttatactggacatgtacaaagcattattgaccgctttttccccatatttttccgttaatgcctggagaaatgtctgtaaaatcttttggttctgtactctgatattttccgtgtgtttttgcaccacttcagtgtttttaaataagggcatttttccaagccaggttaatacttttgacgaaaatttttcaggcgcaacatatgccttatcagtattttccttagcaatatatagccgggtatcactcgacacgccagattttgaaaatgaagacaatgttaaattattcaacttcctctcatcataccttagcatattcctgtagtatgtttttgagcgcttcctgcttattcacaaatgactcaagctgcgatatgatatgataaatatttgtcagatcggtaattgcatgtataaacaacaacgtctctgcggcatcaatatacgctaacgtaccttcattattcgcagccagttcaccattaatcaccataatctgccgccagatagaatcgccacaaacaggcgatagcggtataatcataccgttcaataaccagatatcatctttagcttcaatagacgtaaaaatatcgctatcgagtagtaataagcactgattgttgtcatcaaaagtgagcggtaaacccaatttctcaccaatattagcgataatatcctggtgtgcttgcaatttactttcctctttaattatatcttttacaagattgcttcttcaaatttaatctggttacacaatgtcttgatattttttcgcgcccatcgccgagcgcaatatttctctcctttaatccagtagaatagccattcactacgcatcggaacacaaatcagcagttccttcggatcattttcaacatgacgtaacttgcctttaataacaaaacgcgaactgtcagcaatatcatcatatattgcagccatgcctgaaccgggtactacatgtgtgatgattttcataacaattaatcttgttcaattgttgtcgagcgagagaaaaatactacaccctggactcaagactttttttaacaacacggcatatatccgcaaaggtcgtcatatcaggaagatcgttttcattacaactaatgtcaaactcctcactaagaccaaatacaatatcaattaaatccaatgagtcagcgtaaagatcctcaaccagatgggtctgaccattgatactatcaacatcaacggcaatacaggaggtgatcacttttttgactcttgcttcaatatccatattcatcgcatctttcccagttaattaacgctgcatgtgcaagccatcaacggtagtaataacccgatccacaccaggtttattcaggtatgactcgtaagccgggccagctcgccagctaccgtctccgataaggccgtccagcacattacttaacacatagtcagtttcccctttttgcctggtcaaccccgcctctctggcaaactgcaatgcaatctcagccagtttttctttttgtggatgatgagtaatgacctctttgagcgtctccattttcgctttcaattctgggtgcttgtcaatatcgctacattgcgctttcaacgctgcactctttatcgtgtcattgggtaatatttccccacgcaagccgtcaaacgctctgcgtacaggaaacggtgtagaggcatccggctccagggctttacgtatcacacccaaaaacgcctcacgggcgttgaaatgtattgaatgcatattcgtaacgctcggtactgttgagaggaaactattttgcttaaacttcaaaccagaaaatgggccagtcttatctgtctggctattatcattatcggtcgtaccggctttattacctgtaattaccgtcgagtctgattgtaaggtatcgattttaacattctcgacgccagccagttgactggcaagcggcttcacattcacaatctctgccgtctggctttgctgtttattatcatcaacgccgtgcaccgtggcctgtaacggcttgccgataatgctcttgctggttacgccatcgacttcatcaaaagaggttgtttcacccgtagtgcccttttctgacgtgaccacctttccatctttactttcggatgaagagttggtcacagcctctgccgtcgcatgagccgtgacgtcaattttacccgcgatgccatggtcaattgtccctgtgctggcgctgtgtgcggtctccgtttgatgcgtagtcgaatccacacgcgaatgactatgacttacgttgctgctgttagtcgaatggtgtgactcgccatggcgttggctgttatcaataaatgttcggctattatcaatcgtcttccggctattatcatggttgctattatcgatatggcgctggctattatcgacatggcttcggctattgttaatatgcttactgttatccacgctatggttactgctatcaatattaatattgatattaatacccgtaggttctgcttttttcccaccatcaggtactggtccagccgcaggttccggaattttagggtcaggcagtttatctgcaggaatttgtgcaaaaacattacgtagcagcaggggtatcaacgtttgcatttcaaggtgccgggcttcccgtcctacgctggtaccctgctcttgcgttaatttttggtggcacatatcaagcgcctcaaccgccttcgccgccgctttgtcaacaagctgcgtaagactgctgcgggttaacggatctaacgtacagccaaagttatgttcaatgcagctggcaatatagggcatcacctcctgcataacaagattcgtcgataatttacttaattcaccgccagtgttatttttgatgatatctaacagctgcttttccaggttttccagcttcgcttccgctttctttgtttctggcagccatggcccaaaagctgacttttctttcaggccatcttttatgatttgcgcggtatactctgcccccaccttcatcagtagcgtcttcgcctcaggagaatcactggtggcgttgagcgctgaacgaaagaggccggcaaactccattatcgctttcttaccggcgacattatttgaattggtaaaaacttcttttaacgcctcggcgtctttcccgcatttaaacaacgcatccagactcgcctgtttgatcagcgcgggaaaatcttccagttgctggcctttaatttcccctgacagcgttgctgtggcactttctctgaccgcggaaagattcgccgcaagattcgtggcctgcgttttgatctcggtctgcatacctggcattatgacggggggctgagttcttacacttgtaaccattattaatatcctcttctgttatccttgcaggaagcttttggcggtttccaggctgctacttatcgtactgctcagcacttttaccaggttgtcgtacaatgaattggcattgctatatttttgcgtcagcgtctgtaatgtggttttcagattttcttcctgtgctttaaaacccgactgccaggcttgatatttggcgttatccagttcaagggctgaacccgatcctattccattaagatcgctaaccattttgctcagtggccccgtatccaccagtacgacataaccagaaccagacgcctttagacagctgtccggtaaattcaattctttaatccactgctcagcttccgctttcgttgctgttgtcattccgctgccagtttgcgagggaaataaaatcgtatttttatttatttgagtgtatttattaattaaactacttatttcacttttaagtgagtcaacatttagcttaatggtatttccatccttaccaggcgataaccagcctcccattttggaaagaatatcactgaaggcctgataaaaatcggtatagactgcgacaacgttttcataaacgcccaggtagctgtcacctatcgccgatatattttgggaaaccatatcccaaatctcagcatcagaaatggttgttctcggctgcgccataggcgaagcgctaaataaggccgacgtcggcgcagaaaacgtgctccgcaggttctcattttgttctgcggataatgacacgccggacttcgccagcgcattcaggctgctggtcaactgttggcgcgccagcgtgcgctcgtcattattctcttcagaaatcggtggcgttgactgcagcgtctgctgtgcctgctggattttagtagccgcctgcgataatgaaatgatatctgtgccgcgatgttctgtggtagacggtaccacggcaatctcggcgtgctcgctcgccgaaggagtctgcggccgttcggcaacgatccccggatgaggagaagcggaataattttgaatattaagcataatatccccagttcgccatcaggagggcgattaaatccccccctgatggcgtatagttgatctgtcagattaagcgcgaatattgcctgcgatagcagcgagtgcggatgctttcgactggttaatgctctccattgttttcagcatttcctgaatcaggctggtcgatttacgtgaactttcacgggcttcgtccgatgcggtgctggcaacccggttattcacctggctaatttgctgctcggaacgttcctgagtagcggcgtactgcctggacgcccctgcaataccaccgaccgtgactgagttcttcataatcagatcgcccgtcatctgcatcttgcgcgcatcgattcgggtcatatccatggtattctgctcaagacgaatatcggattcgacagactcaagacgtttcgacagaatagcctgatgttcaggggagatttgtttattactgtttttaatacccagactttccgtggcgctggttccggcattagatttaagcgtcgcatcattaagatttttcgtcgcatcggtaccggttttcttcatatttaacgatttcagagaatcgacgccttcagcaccaagtttgacgctattctgcccgttcagcacgtttttaatactgtggctttcagtggtcagtttatcgatcttcgcggcattatgtttaagcgcgcctctttcattctgcagccccttatattccagtttggcgcccacgccagtgatccccaactgaagcgcgctctgggaaatactaccggacaacgcattcatcccttcgcgcatcatggagcttgccgtcgttttagctgcatcaaaactgactaatgacaacttaccagacagtttgctatcagcctggttcaacgtcagcattaacgtattcgcggcagccaacagcgcaacggcactggaagacattccgctaatatcaaaaaactttccgacttctgcctgctgctcgcgtaactgggtttgcacaacctcattcgctttagtcgtgacattatttgccagggcattcaaatcctgattcatgtcggtattttgaatactggcttttaaaaaggacgtgatcgttccgggggtttgcgttaatacccctggcgcaggcgcgctcagtgtaggactcaaccccaggtcactgactttactgctgctaataccaatactattcagaatatctttagcgctaacggattgcgaagctgtctgtgaactattctcaacagaatgattatttaaataagcggcgggatttattcccacattactaattaacatatttttctccctttattttggcagtttttatgcgcgactctggcgcagaataaaacgcgaagcatccgcattttgctgtaccgcagaagacatggctttttgcagttccgccgttaccttctggttttcaccaaatatttctacggattgtttaagccactgctgaatctgatccatggcaaaacgggcgagcataaaatcagcaagcgcctcgctggcatttttaataaataccccctcggcaaccccaccggctgactgggctgcggtattcgtgacttccatgcccaacgccactttatttagggtattacctaccagctctttacttaaggcattcgtttgcaggcccatcttgctacccacattacccaggccgctagtaatacgttgcatcccctgggtaaagagtttgctgccgttttgtgccaactgtttcagcacgttaggcaccaacttcttaatcgtttcgcccatcattttgctcagcgcgttacccagtttcgccgccgcgcctttcccgacaactgcgaccaccacaatgaccgctaccatggcaatagcggcgacaatcgcaccaacaatgctgcctgccatctctgccgttttcttatcgacgcctaatccttccagcgctttggtaatcgccttgccaatcagctccattaacggcttcagcacatgctccataatcgggtttagcgcctgctgaataaacgacacccccgtcgccgccttcacaatttcatcggccaccattaccgcaagtcccaccgcagccagcgccagactcgccccaccggtaaaaacagcggccacaacgctgacaatggttagcagcgcgccgaggactttcccgatacatcccataatgcggttcgtttcctcggctttgcgcgtctcttcctggaattcagccgatttcttttccatctccgcctgacgcccttcctgcaaggcgttgaaaagcgcaagatcgttttgcaggctttcttccgtatttttgcccacaatctcaataaacatggccatgagcatagtgaggcgggcgacatttgacagattatcctgctcaccctgggaaacctgattctgagaggcggcattagccgttccctggaatttggtcagaatgttatccgctttctcggctttcgctttggcgtctgtgcctgctttaaccgtcgcatccgtggccttatctaaggcctctttcgcctctgtcgcttcttttccggcctgttctaccgcggcttcagcttgtgcatagccggggtcagctgggtccagcgattgcaatttattttgcgcctgcgtcagttttttggccgcagcgtcataaacactcttggcggtatccgtctttttgatgctggcttcatagagatccgtcgcctcctgagcctctcccagagccgtctggaattctttcgatacctgaatccccatctctttttgtgactcaatcatcgcctgccataccgccagacgagactccagttgagacagcgaaacatcgcccagtagtgtcattaacttgccaagcagtaatgtcaattgcccttcgctggagagtttttcccgggcggcgtccgtaggcggctttagacccaccgtattaatagcgctctcgccggactttgttccggctttaaggtcgcccgctttcgttgccaccacatctttaaaagctttatccgccgcttttaaaaagtccgtgttcttacgaacgccttcaaaagccgcctcagcgaggcgcggattttgggtatatccgctacggctaatgctacttgcgtcatttaccataattattccttttcttgttcactgtgctgctctgtctccgccgtttttagcgcctccagatagaccaacgcttttgcccgcagagactcatcttcagtacgttcattgacaagttcaaaacactgtctggcttttgccgccttacgcattaataattgacactgcccggtaaaaaaaacggggcgataatcatttttaagtaacgtaaacgctactgcataaaggtcacatgctttctgaaattgttttttcagttggcataccgccgccagtcccatggtgtaatcgggattgtaaaaatcataaatgcataagaaacgaaagaatgtctcagcttcatccagtcgtccctggttataaaactcataagcatgagcatataaaccgtccatcatatcttgagggatcccgtgaacgtcttttagcgtggcgccttcactaacggcatcccaaatcatttccgcaacacgttcttcgctgacattattttgataatccattacttactcctgttatctgtcaccgactttgtagaacttaacgactgcgtttatctgatgcagttattaaaccccgacggtggttagtgaacattcaaaaaactcccaatgaatacatcgctactgctttacgcggctcaatgccgtacctcgttttcttgtggctgaataacgtctttgcccgcgttttctacctcttccagccaaaccagaagacgtaaaacttcatcaatttcttccagactcaccagatcataacggcgatgggttttgaaaagactgcgcgccagtttgatatcgacgatcacaggtacgccaaccttctccgcataggcgcggacggccagtgcgcgctgattcgtttcatacaccgagatcatcggaatcggcatcaattcgggtttaaaataaatcccgatcgtaatatgcgtggggttggcaacaatcaggcgtgagttttcaatatcggatttcacctgttcagacagaatttccatatgaacttcacgtcttttagatttaacctctgggttcccttcctgctccttcatttcacgcttcacttcttccttatccattttcatatctttcatggtcaggaaatattccgcaatagcatccaataataagacaatcaatgcgcaagcaaggcaagttaataccaatgcgaggagaagttcacgccaaatgacggcaatatccacaacattgccatttaactgagaaaagatttcaaccttatatttcttccagcaaatgatggcggccaccacaaaggatgagagatacagtagggttttgaccgtatctttaaccgtgcgcatactaaaaagttttttcgccccttctaccgggtttaacgccgataaattaggttttaatgcttctgtcgccagcacgaaaccggcctgtaataacgccggtaatgcggaacacactaaacagagcagcataaatggaatcagatattttaatcctatcccaaaaacggccaaactgtaatcagccatgctctgatcaaaattatccgcaataatgatcttaattatccccataaactcattaaatgagccatacgacaccagataggcaattcctcccagcgtcagacaggcgataatgagatctttacttttaaatgactggccttttttagcggagtcttccagccgttttttagtcggtttttctgttttattcgaggacatgcgtcgcccctcgctcgtaaaaccaactgcttaaccctgtggcctggaaagagagtcgcggtacattgtccggtagtaccggagagaaataaagcagcataattaaaacggcaatgccgctttttaccgtcagtgaaatcgcaaaagcgttcatttgcggagcaaagcgcgacaataaacccaggaatacttctgacagcaacagcactaataccaccggactggccagaaccaaggcgttttgagccacctgattaataaacgttaatagcggcggtaatgaaggcgtgcactcgttcatcggatcgcatagctgatagcttttatttaacacgtcaaccatcgtgaccagaccgccgttttgtaaataaacgacagcggcaaacatattcaggaaattagccatttccgaggtatcaataccgtttgccggatcgatactgctacttagcgttgcccctcgctggttatcgataatacaacccagcgcatgcataacccaaaaaggccatgacagcagacagcccagcatgacgcctaccgccgcttcttgcagaactaacgggatcatcgccaccgataaaaacggcggcgcctcgttcaatgcatgcggccatactcccaatgccaccaggatgataatggcgtttctcggcgcgccgcttaataccccgctattcaaaaacggcaggaagaaaaaaatcggcgctacgcgagcaaaccctagtgccgcagacgcaaccaggtgatgaatttcaaagtacaacgcgtaaagcattttttaccccttagccaacgccaggaatatcacctgacgcccgtaagagagtaaaacttcgccataccagccagacagtaaaaacaagcataaacacacgccaagtaatttaatgccaaaaggcagcgtctgttcctgtaattgcgttaccgtctggaataaccctaccaggaggccgataatcgttgcgacaatcgtcggccaccctgacaggatcaaaacaagatagagcgccttattacctgcaaacactaaatcatccatttaactatcccgtctcgtaatgatgtcatgttgcaatgtccatatactgtaatatcaatcccttagacagtaaggtccagccatcaagcgcgacaaaaagcaccagcttaataggtgtagatatcgtcaccggactcatcatcatcatccccagcgccagtagcacgctggataccaccaggtcgacgacaacaaagggcaaatagagataaaaaccaattttaaacgcgctttttatttcgctcagcgcataagcaggtaataacgcaaatattgatggtttttcaatttcatctttgtcacgctttaccgtctcggtctcttctccatactgacgcttcagttgcgcgttttcaaaaaactgaactaactcgcgatctgaatatttgatcagataatcgcgataaccatccagaccttcatcaacgtgtttacttaatgacgaaatatcattaaaggtgacatcttcgtcctcaaaatagacgtaggcatcatgcattattggccacataacaaacatagaaagcagcaatgcgacgctgttaagcgtcatatttgaaggtatctgctgcaatcccagggcgttacgcaccatgacaaatacaatagaaaatttaacgaaacaggttcctgacgcaataataaatggcaacagggtggaaaatgccagtaaggcaattaatgagatatcattccccattaccagactcgctcagccattcatggatctcaacgcctaaggtgtcattcatctgtaccagttcgccattaccaagcaaaacaccattcgccataatttcaacgttaagttcaacattggtcggcagtgataatagctgttgctgccccatggcttcgagttcggcgagggtaacgttcttacgatacaaaacaaattccagtttgacgggcaattgattcaagccaggcagagtttctgcagtttcagttgtattattttcttcttcgatatgttgaatatctaacgtttccacaataattcccccttcaacacggttgaaatgacctaactttttcgcgtagcaataaacttccgcacgggaagtacgaatcaggagtacatctccgatcccgattcggcccagcaaagaacgctgcgtatcactgctaccgattacaaagcgcaacggccaacgcagcattttcggcctgccgcccccgactgcaggcagttcaggaagatgctcaaaccacaggccgccccgatcgctcataatgtgcaacaatttcccttccggcagcgcgcttcccggtacggggttctctacgcataaacgccgacaggacaaatgcggcacgggcaactcaaacggtcgctctgttgcagcaagccagggaacgaccaggtgctcagcaccggcagaaaccgccgcccccgccagagcgggagagacatgctcaagccagcccccaggtttaatccaggccgaccaccgtttttctgcatcgctcaaccgaacccacattccctgtcgcgtcggatattccagcgtcgcttcccggccatggcgctggcattctgtcgcggtttgcgccaatagccattcgcgacgatcaatctgtctcacacgcaatgacatcaggcgtcatcctcctcgccagattgctgtctgtgctgttgctgctgcggattttgttgatcgtctcgcgtcaggtgccagcgctggggattaccgttttgccattgatcatgcaaacgatgttcaacctgcgtatttgacggtattaacgaaaactcccctgcttgccgcgcctgaatattgacggaatagtcatttccccagcgctgaaaacggtaagtcagcgagctatcctctcctttcacgccatcggcagtgggaaaaatagtcatcatcggctttgattgcgccgctaaaggcattttttcatcgccgccggttaattggctaagatcggcgatagtggttggttgcagcggaagctgagaaacatctttaacctttttatgatctttatcgtcaggcttaccggtattggctgcggccattcgggcaggtgcgacatcccgcgccagcggcgcgccctctttacgaacgccttcgcccgcgatggctttattatccccaggcaatgccttgatattatcgtcagagattcccgtggcattatcggttacttcactaacggattccacggcttttaaatcagcagataattttttaccgcttacgctttctaacggcctatttttaggcgatagcaacgctgcggatttatctactttggcctccgcagaaatcaaaccgacagatttttcagcagtgactttcaacagtttttcagcaatcctgagttcgccttttccgttatgatgcagaccagaaacgttgccattgtgatgttctgatttcgctggcgcgcaatgtcgccatgccgccagtaataccggtaaagccgtttctttatgcattacgaaagcatcgccatagtcgcgatcttttttatcaccggaatattctgtcttatgtttttccaccgttttttttaatgcttctgataaaccgccaacctcatcctgctgcggcagtaaaatgttcccggatgaactgacagctgacacatcgcccattaaattatctcctctgactcggcctcttcctgctgtatctctcgctggatatagtgtcttttctgacgaattatccagcgttgatagttcccttctttgcgcaaccaatatttactttttttctgaaactcttcccttttcttttccagctcgctccgtttttcctgaatttgtataatctggagttctaaatcttttatctgccggcgaacaatagactgcttacgtaataacgtataaatttcctcacgactgagctgtctgttttctgcacgcagcgtatctaataacaatttcagacccgctatttgttcaaggatcgcctcctcctcggcctgcagcccgcggtcctcatcctgatagcgaagtaatattgactcacactgtgaatgaaataccgtacagcgccgctgtaaaactttaattctggtcagcgaatgcattcataccgctcaacgtgtcatcaaaggatgaatattgcgctaccggctggcataaccaggctttcaggctatcccgcatctgcatcgcccgatcgttatcgatattttcgccaggacgatattctcccaagtcaatgaaaagctggagctcttccagacgcgtcattaatttacgcacggcagatgcctgttcagcatgtgtcggcgtcgtgacttgtccaaaaacgcggcttacgcttttcagtacatcgattgccgggtaatgtccctgcccggccagctttctgctcagatacaggtgaccgtcaaggatagagcgaatttcatccgccatcgggtccgcctcttcctcgctttccagcagtaccgtataaaaggcagtaatgcttccctcgctggtcgccccggggcgttccagcaagcggggcaaattatcgaatacggaggcgggataacctcgacgggccggacgctctcccgacgccagtgccacatctcgcaaagcacgcgcataacgggtcatggaatcgataaaaagcacgacccgttttccctggtcgcgaaaatattccgctacggttgtcgccagttgcgccgcattgcagcgatcgaccgaggggaaatcggaagtggcaaaaaccagcacgcatttttctttcttatgcgaagcgcgcaacatatccacgaattcagtgacctcacggcctcgttcaccgataagaccgataacaaagacatccgcctccgtttgctcgatcagcatatgcatcagcatggtcttaccgcatcctgcggaggcaaaaatgcccattcgctggcctacgccacaggtcaataacccgtcaatcgcgcgcacaccggtaatcagcggttcacggacgccaacgcgcgaagcgtaagacggcggtgcgacatcaataacgcgttcttcgctaatcggcgccacttcaggggtaaaacgctcaacgattttccctgtcggatccaacaccgcgcctaatactgagtatcccacccacgccgataacgcacgtccagtgggataaagcacgacatcgcggctcagcccctgggcattgccgataaggctcagcacggtgcgttcccgctgtaagccaaccacctgcgcacgtgcaacaacctgtttttggtgccagccacggcgtatttcacacagttcgccaatggccacatcgcgcaattccgcctcaataattgggccggttattttttgtgggtaggccagatattgcagtaaacgaggtgttttcatctcattagcgaccgactaaaaacttccagatagttgtaaaacccattcaaggcagtagagaacttttcaccgtcagataaaaaatccggatgcactaaggctttaagcgttagctccccattctgctcccccagtagtaattgcccgccgcgggcaaaatggcatccttccattatggtcattaagatttcataagcccgctgttgtaataccaccatgctgtcagcacccaattgcgcccagatccatacatcatcgtccttgacgctgatacagatacttggcaatgcaaataaatccagaacaattgttgaatggctatctattcctccaattaatgaaggatcgcaaccacttacttccagtgcggaacgaactaattcagcgatatccaaatgttgcatagatcttttccttaattaagcccttatattgtttttataacattcactgacttgctatctgctatctcaccgaaagataaaacctccagatccggaaaacgaccttcaatcattttcttaataaatcgacggacatcgacagacgtaaggaggacaagatctttatgtgcaatcaataaatcatccaacttaagtgtaatgagatccatcaaattagcggaggcttccgggtcaaggctgaggaaggtactgccagaggtctgacggatccctttgcgaataacatcctcaacttcagcagataccattactgctcgtaattcgccgccattggcgaatttatgacaaatataacgcgccattgctccacgaatatgctccacaaggttaatgacatctttttctcttggcgcccacaatgcgagcgcttccataattaatttcatattacgcacggaaacacgttcgcttaacaaacgctgcaaaacttcagatatacgttgtaccgtggcatgtctgagcacttctttaagtaaatcaggaaatttcgcttccagttggtccagcatatgttttgtttcctgaataccgaaatattcattgacgttgcgcgccagcgtcaccgccagacagtggtaaagctcatcaagcgcgttccgcaacacatagccaagctcccggagtttctccccctcttcatgcgttacccagaaatactgactgctaccttgctgatggattgttggattaatgccaaaggaaacaacttcatcggaataatttaccactcgcatcaaatcaaaatagaccgtaaattgttcaacacggatctcattaatcaacaatacgatgctgttatcgtccaggccctcgccatcgcgtaacaatacttccggcaggcgcacgccataatcaataaagaactgactacgtaggcgctccgcaagttgagctttttccagatcttcacgccggctcttcggcacaagtaatatcaacggtacagtctctgtagagactttatcgagatcgccaatcagtcctaacgacgacccttctttttcctcaatactgagcggctgctcgcctttgctggttttaggtttggcggcgctacgttttgcttcacggaatttaaaatagaagagtacgcttaaaaccaccgataaaataacaaataccggcagcgggaatcccggcagagttcccattgaaatggtcaaaatagccgtaacaaccaatacaaatgggttgttcaacagctgcgtcatgatattccgccccatattatcgctatcgccatttacgcgagtcacgataaaaccggcactaatcgcaatcaacaatgcggggatctgggcgacaagaccatcaccaatggtcagcatggtataagtagacagagcggaggacaaatccataccatggcgggtcatccccaccgaaataccgccaataaagttcacaaagatgataatgatgccggcaatagcgtcacctttgataaacttcatcgcaccgtcaaaggaaccgtaaagctggctttccctttccagtacgcttcgccgttcgcgcgcagcatccgcatcaataataccggccttcaaatcggcatcaatactcatctgtttaccgggcataccatccagagaaaatcgggccgcgacttccgcgacgcgttctgaacctttggtaataacgataaactggaccacggtgacaatagagaagacaacaaaacccaccgccaggctatcgccaataacgaattgcccgaacgtggcgataatttcaccggcatcggcttcaatcaagataagacggctggtactgatcgataatgccagacgaaagagcgtggtaattaacagtaccgcaggaaacgttgaaaaactgaggattctgtcaatgtagaacgaccccataaacaccaatatcgccagtacgatattcagtgcgatcaggaaatcaaccagataggtaggtaatggaatgacgaacatagaaatgatcatcaccattagtaccagaatcagtaattcaggtcgtaaacgagcactgttaagtagagaaagcagcactataggtatcctgttaatattaaattaagacagcttttcaatagtacgacgctgttctgccatttcatgcttgtaggcaatatcggtcatactacgtaacgccattaacaattcttcctgccaatattcttcataaaagagtgaagagggtatggctttacatacttgataaaatatctgcaaaaaggatgcatgttctttatgactaagcaataacgcattcaaacctataatatcggctaacagcgaatccacttcatgtggctgttgcaatagcgaaagcatcagtagtagccacgacgactcctccgcattaaacgctttggtaaacgaatacgacaacaatgtactcacaaacagtaggtcagcggagcgcaacattttaagttgcgtcaggcgtcgtaaaagctggccaaactccaggcgcgaacagctggcgtcattcgcgtcaatatcggttaatagcgaaccctcgataaaatccagtaccaccagtcgacgttgatagccataactggctatccagtcagagtaaatctccacttcatgtgattcactctggataaattgccgatagctggcgcgcaataagcctggttttaacgataatgttttcccaaaaagccgggccttcaacgcacaattaatccctgccttgagggtcttcggatcggtttgctcttcaacgtgcttaagtaacgactccagctttttccgcacgatctcttccaggtctttacgacgaagcaattcgcgtaacacaaggactaaatcactggggtcaggaaataagctacgcgcctgacgtaaaaaatcttctaacgcgccgccatgtacgctaattagctttaatatttgcttcgccttcggtaaagcctcatcctccagcacgcgttcaaaactgttagataaattactggattttttttcataatcgcgacggttacgaaattgcgccagcgccgctgacatttcgtccgtcgactggacaaatttttgtacttccgcccctggagacgaatcctctgcggcctgttgtatttccgcctgttgcgcatcagtatgttgggtcgcatcctgatgagatgcctgccgggacaatattctggaaaatgaaataccagaggttgagccaggaatcatttaattacctcctgacctctatccagataaacacgaacccatttctgtaacttatcgtccccactccaggcaccgctttgcttcagaatattgtttaccgattcgctggcatccggcgttaacgggtcgacaatttcttttggttcaatcatgaacacacgaacaacattacttttattcttactggaataacggaacaggctaccaataagcggtaatttgcctaaaaccggaatactttggacagtatcggtatttgcatcccgtgtataaccaccgaccagcaaactttttccgtgcggaactcttgcaatagtgctaattaacgttcgcccgacttcgggtaacgcatctacggaggtggtagtatcggattgcggcgtcttatcgttgccatcttcaatgtccagcgacatttctatctgaccatctgcggaaaaacggggcagcactcggatcattgttccgtatgttacatgctcaagcgccacattacgttccccaatcagcttggtgtaaaacgttctgttgttatcaaaaatagcgggaacattttcctgagtcagtaataccggacgcgaaaccaccgtcgcctgtttcttctcttctaacgcattgaccgcggcgatgaatcgactgccatcgagggtacttattgaagactggtttaatgacacgccaagtttgtccccaatagttatgctgccgctccatgaagtgcccaaacgctccagatcgcttttattaagatcgacaatccacagggataattctacgtgacgtttggcgacatccagcgctttaaccagcatttcgataaaatgcacctgcccagccgttccctttactaacaaactgttggtatccggataggccacgattttaatattgcccgccgcggcattttgctttaaagcttcctgcagactcatgccaccggcataatttgctgctttacctttttctccattcgctgaaaatgctggcatcgccgggggttcgctactgacaatattacctaagggttgctcttctccctgcaataacctttcaatggccgtagcaataccgggaataaccattttctgatcgcgcagattgtaggtacgatcgcccacgaaggtattgttcagacgcatcacccctattttctggcgtcccagctcaataccatcgttttgcttgtccatcatggtggcggcgttgaccaccatatcaacatagacgggtggccctgaaacatagaatgttcctttacggttatcgccacgtagcgggtaatttttgttatataaacctgagcgttttagaaaattgttgaactcattgagtgagacgttgcgtaaagaaaccacggcattgcgcatttcactggcgtcataaatatagatagcctgcccatcgaaataccaaatcagccccagttgtagggaaagcttctccagtaatgcgttaggatcgtgaaactcaaagttgcccgtaattttttttcgtgccgccattttgctaacaatgacaggctcctttagctgtagcgccatggcatcgaaaaatgtccgcaggctatcgtctttcgcaacaaacccacttcccgttacaggtattttttcactagaataaccaggtgcaaccagaacaagcgcggcacatgccagcactctggccaaaagaatatgtgtcttcatttgtctgccaattgaataatatttgataatttccgcggcgaaacgccgatcagctctttgatctcactagaaaaatgtgaaggcgatgagtaaccatgattaacggctaattgggtgatgttctcgtggccttctacactattcagcagcgattgcgccatacgccagtttcgtaattcactcttcgcttttccgcccaacgctctgctgcacaaacgacgaaaatgggtataagaaacgccatagtcttctcccagcattctcatcgtgttgccgctggttgactgagcgagtaaatagccaaccaaccagtaactctcgctttttcgtaacagcgccagtaccttattgaaggccggagaaggcgtaataatttgctgcaaaaaccagtactcgcagcgtttacgatcttgccaaatagcgcgaaactcaggactcagcaaaacccatttatcggattcagcatatgtcgtgtccactaatcctgcgccatcgataaatgccagtaatttgctgagtacttcaatttttaacggtcgaaaaaccaggtctcctgatactggtgcgacaacggcctgctcgcaaaaaagcagcgcgccttcctgaatcaggcagttttcattgtgtcggctttcagaaaatgacatatgcagcttttgcgcggaacacgtctgtataaaccatgcttccgggctgcggattttccgcttctctccttctttaagtacttcctgcgtatttagcattgttgtcagcaccagttaaaaatcattttaatatgtaaacaataccaggagcgggtggcaaaatcctgatgcaatcattatgaaactgatgccacccgctaattaaattagccaacttgcacagcgcttgctgatttaaaatagaaaatcagctcatagtatacaaattatggcttattgttctacagcagcaaaaattcagatattgtcatcgggatggagaattaattatttatatcaggagttttttttgctagcattcctgaaacgcattcgccccttatcactattgtcagataacattctgacggttgtgtaaaaacatggcgcctcattcttctgtagttggagttaatatgaaaaaattttatagctgtcttcctgtctttttactgatcggctgtgcccaggtgcccctcccttcctccgtgagcaaaccggtacagcaacctggcgctcagaaagagcaactggccaacgcaaatagtattgatgagtgtcagtctcttccgtatgtgccgtcagaccttgcgaagaataaatcattatcaaaccagaacgctgataattccgcatcaaaaaatagcgcaatcagctcaagcattttttgcgaaaaatataaacaaaccaaagaacaggcgcttaccttcttccaggaacatccacaatacatgcgttcgaaagaagatgaagagcaactcatgaccgaatttaaaaaagttctacttgaacccggaagtaagaatttaagcatatatcagacgttacttgctgcccatgaaagactgcaagccttataaggccatatcaccgctgactgaactcatcatgatataattaagaccatactttgcattgccacttaatatcaatataattattatagctatggtcacttttacggttggccatttgtctcttacgttgcatttatcaatctgctttttgatacagcagcacctcgctgctgctttttttatttgtgataaagaacggcctcccaaactcgggaaaatagccgaaacttatactgataaactatcgtctcgtatatcgcgataaactgacatccccctcttgccccacatgttggcattcttacgataccccatccacttttcgcggataacgttcttttgaacttacccagcaatagtggacacacaactaagtgagtaaacgctcaagcaagaggtgactcacataacaaaaccagcatcaaccaccaaaaagccacgcaagcagcacacgcctgaatttcgtcaggaagccctgaaactggcggaacgcattggggtgcccgctgccgcccgtgagcttaacctgtataaatcacagctctacagctggcgaagcaaacagcaaactcagctctcttcttctgaacgtgagcaggagatgtccgccgcttagggttgtgtccatactacgcgggtaggatcaatcaagcagttacggcaaaaaagagaatcatgaatatatttagcaaactccctgatgatacgtaatcagtgagattaaaataatgcaatcgcgataaaccgaagttaatgccctgtttaaagacagtgaacgaccttcttgccatgtctggactatatcagcctcacatgtacgctttgaaagcgtacagatatgtattataattgtacatattgttcataaacaggaggatgaaaaccatgcctcagatagctatagaatctaacgaaagattgtcgttacgtgtatcgacggatgccaaaaagttgatagtccgcgctgcggcaatccagcaaaccaacctgacggattttgtggtcagtaacgtactacctgtcgcacagaagattgttgatgccgccgaacgggtatatctgacggagcgtgatactcaaatgatcatggaaattttagataacccgccagcgccgaatgaaaagcttcttgccgctgctttcgccctgccggacatgaagaaatgatgtttacagactggcatgaggccgcgatagggaaaacccacaatcgaatgaattttgattgtggggatgccgatctgaaccaattcctgcaacgccatgcacgacaaaatcatgagaaagggacaacaaaaacctacgttgcgcttgataattcggatgttacacgtatccacggcttttactcagtcagtcctgcatcactgatatatgcacaggttcccggcgcaatcagcaaaggattagggagatatgatgtgccagtgtttcgtctgggtcgtttagccgtagacaaatctatgcaggggcaagggctgggagcacaacttttgttatctgccggaaagcgttgcatacaggcggctttgcaggtcggtggcgtagccctgcttattgatgccaaaaataaacaggtctgcgactggtacaaaggatttggcgcagtaccattaaacgatcaacccctttccttgttgctgtcgtttaaaacgctttatgctgctttatctgcatctggtaggttatgacaacatgaggctttgttgaataattcagaatcggccaacgataaggatacaggactcccaccggagcactcgttatacgagcctgacgctggtcagcattgccaacaacgtcatccggttcagcgctttgaccatcgccatcgccatcgcttcacccacctgcgcgtcatagttccgcaggctcagatggccgcccagcaaggttttgagacggaacatcgctgtttccactactgaacaacggtgatagcccactttcttttccagacctcattgctgccgctcagatgttgattcgccaccgcgtggttacgctcatggtacttgcccggccagtatcgcgcaccgcttcgtggcgggattagcggcctgattaataacacatcatggcaatagcgcgtgtcataagcgccgtcagccgaggcttccctgattttacggtgagtctggctaatcagccccggcagtgcctgcgcatctgtcgtgccgctgagcgggaaagtatgcctttgcaattaatcaggaaagtgttgcgcgagaaatagcgcatctttcaagcacatcgtctactttaattaaccgattcataaaatatatattatctgttcatttctagcttgtaggctattttaataactgtgtattttaaacaataaaaattaatattaccctacttctttgttataataccagcctccaaaattgtgctataggaacatcatggaattaattcgttatgctgacatcaacagcgttctctatcgccacatttgggtcgttggtgatattcatggatgttactccttattgttaaccagactggctcaattaaatttctctcctgataccgatctcttgatctccactggagataacattgatcgaggaaaagaaaaccttgaaacactgagactgttaaatacctcatggtttatttctgtagtgggtaatcatgaagctatggcgcttgacgcttttgaaacacaggatggcaatttctggtatgtaaacggtggttactggtacgactcggtcacccaaaaagacaggcaagaagccactgagctattactaacttttaagcagcgtcctcacatcatagaggttaaaacgtcctcaaagaagtacgtgattgcccatgccgattatccagatgacagctacgattatgggaagcaagttgatattgatagcgttctatggtcacgcgatcgtctgcttagttcgttacaggggaatatccatccaatacgcggtgcggatactttcatcttcggccatatgattgttgattacacaacaacattcgccaatcaaatctacattgacaccggttctttctgttcaggcaatctgtctttttttaaaataaagtagtctggaaatagaattatataatattaaccctccctgcattatggcaatgatatagccttcaataagtaccattgctcattcgtaatagcgtctaaatttcgcgtttttccgcccatttcatcattaagatcgcagaccaaaaaacgaagccgtaatccgacgcaggtagttactcgatcgcctgagaagagtaaagatcgcacagctcaagatacctatcggaataaagcacaataaccgtggtggcgaaatggatcggcttgccttcatgcaacacaatcttgattacggtcttgagttcggaagcatccgtttccctcttaattttgttgtgatttctctttgttgcgaacatggtctgaactaattgcctgcagattgccttgtttcgtcaatatttggaaaatcgaacacattttcaacttttactttcaagacagaacttggcttcctaccctcactgacattacgatctgacgaggctactcttcgctggattacgtaggtttttttcgtcaaactggcttttaccccgaaaccagcaggagcttgtctgtggtcatcgaaaacaatgtagagtttttgagctgggttagcttcgaaaacgatttttccagagcgactgagcgcagacttaacattgatacttaacttgttgataatgaaaggctggctgagagttgttttcaaagtatcacccctgttgtagtccaggaatgatgagaatgtaacctgtcacattttaggctacagatgagctacaaatttatgggtttatgtgagtttataggggttttacctatggccacatgagcacttgaaagaataaaaaacgagtaaaatcaatatgaatgagtcatttgataaggacttctccaaccacacccccatgatgcagcagtatctcaagctgaaagcccagcatccggagatcctgctcttttatcgtatgggagacttttacgagctgttttatgacgacgcaaagcgtgcgtcgcagttgctcgatatttcgctgaccaaacgcggcgcatcggctggcgaacctatccctatggcgggtatcccgcaccacgccgtagaaaactacctcgcgaaactggtcaatcagggcgaatccgtcgctatttgcgaacagattggcgatccggccaccagcaaaggtcccgttgaacgtaaagtcgtgcgtatcgttacgcctggcaccatcagcgatgaagccctgttacaggagcgtcaggataacctgctggcggctatctggcaggatggtaaaggctacggttacgccacgctggatatcagctccgggcgctttcgtctgagcgaacccgccgaccgtgaaacgatggccgcagagctgcagcgcaccaatcccgccgaactgttgtatgccgaagattttgctgaaatggcgttaatagagggacgccggggtctgcgccgtcgcccgttgtgggagtttgagattgataccgcccgccagcagttaaatctgcaattcggtacgcgggatctggtcggtttcggcgtcgaaaatgcctcgcgtggattatgtgcggcaggctgcctgttacagtacgtaaaagatacccagcgcacctccctgccgcatattcgttccattacgatggaacgccagcaggacagcatcattatggatgccgcgacccgccgcaatctggaaattacccagaacctggccggcggtgtcgaaaataccctcgccgcggtgcttgactgtaccgtgacgccaatgggtagccgaatgcttaaacgctggctgcatatgccggtacgaaataccgacatattacgtgaacgccagcagaccatcggcgccttgcaggataccgtcagcgaactgcaaccggtgctgcgtcaggtcggcgatctggagcgcatccttgcgcgtctggcgctgcgcaccgcgcgtccgcgcgatctcgcccgaatgcgtcacgccttccagcagctgccggaattgcacgctcagcttgaaaccgttgacagcgcgccggtacaggcgttgcgtaaaaaaatgggcgatttcgccgaactgcgcgacctcctggagcgcgccattattgacgcgccgccggtactggtccgcgacggcggcgttattgcgcccggctaccatgaagagctggatgaatggcgcgcgctggcggacggcgccaccgattatctcgatcgtctggaaattcgcgaacgcgagcgtaccgggctggatacgctgaaagtcggctataacgcggtacatggttattacattcagattagccgtggtcaaagccatctggcgcccatcaattatgtgcgtcgccagacgctgaaaaatgccgaacgctacattattcctgagcttaaagagtacgaagataaagttctgacctcgaaaggcaaagcactggcgctggaaaaacagctatatgacgaattgtttgatctgctgttgccgcatctggccgatttacagcagagcgccaacgctctggcggagctggatgtgctggttaacctggccgaacgcgcctggacgctgaattacacctgcccaacatttaccgataaacccggtatccgtattaccgaaggtcgccacccggtggttgaacaggtactgaatgagccgtttatcgctaacccgctcaatctgtcgccgcagcgccggatgttgatcattaccggccccaatatgggcggtaaaagtacctatatgcgacaaacggcattgatcgccctgctggcctatatcggcagttacgttccggcgcaaaacgtggaaatcggccccatcgaccgtatttttacccgcgtcggcgcagcggacgacctggcttccgggcgttcgacctttatggtggagatgaccgaaaccgcgaacattctgcataatgcgacggaaaacagtctggtattgatggatgaaatcgggcgcggtacctccacgtatgacgggctgtcattggcctgggcctgcgcggagaatctcgcgaataagattaaagcgttaacgctgttcgctacccactacttcgagctgacccaattaccggagaaaatggaaggcgtggcgaacgtccacctggatgcgctggaacacggcgatactatcgcgtttatgcacagcgtgcaggacggcgcggcaagtaagagctatggcctggcggtcgcggcgcttgcgggcgtccctaaagaagtcatcaaacgcgcgcgccaaaaactccgcgagctggaaagcatctcgcccaatgcggcggcaacgcaggtggacggcacgcaaatgtcgttgcttgccgccccggaggagacatcgcccgccgttgaagcgctggagaatctcgatccggactccctgacgccacgccaggcgctggagtggatctatcggctgaaaagtctggtgtaaacgtgtcagacccgatagcgccgcgctatcgggtctgcgcgccggaacaggcttttcaggctgtggctgtcgtttcatgtaaatgacgccagactatccgtcctctttccctttttaaaatgaccgtcgaccagcgtaccgtctcggcctggcccggcagttgctggcgctcacgataacgcagcgcggcgccttccggccactccgccacaagatcaatgtgctcaaccatgataaccagccccgggcgacacgcgcgctgcgcctggaaaaaagcgcccagcgccggataatccagacaaatacctcctggcgttatcatcgtaaaatcaacagcaaaacgcgctatcaacgcctccaggctaccccccccccccttactaagccagttctcaatcgccgcatgggcatgaataatttcttctttatatggattcatgatctttcctttttcaggcacagaagcgcctgtctattgtttagacagacagcgtaaataaggggcagcagggtgataccggcggcggcaataaaggtccagcgataagcaacctcaagcgacataacgcgctggagcgcgtttaacagcagcgtcaacagcgtcgcgccaaggaaaaagctaagctgacgattaagattccatagcgcgctggcgtcaggcatgtcccggcgagcaatagtcaggaaagcgccactctgcgcggtactgctgcacaaactgccgccagcgcccattaaggcgaatatcatcatcagtacacgatgcgatgtcgcaggcgtaacgttagttaaaagcagtatccctgcagcctgaagaagacagccgacgataatcagcggacgcggcccaagccgattgaagtaacgtccggtaagcataatggcgacaaatgaagcgatcgaccaggggagcatcagcgaccccgccgccgcaggcgatagctgcgcgacgttctgtagataaaacatcccgaccacgctgataccaatgaacatacccggcacacacagatagacgatcatggcaaaacgcagcagcttgtccgtcaacaacggcagatggagcaatcttgctgacgccattgtcgtcgaagcgacgttcagccaacgataagcgagcaataaagtgagaacggccaccggcagcgtggcaaaaaatatccagcgccagccgcacgtttccaccagcagcccgccaatcgcaggcgaacatgccggcgccagtagcgccaccatcatgacgaccgatgacacgccagcgcgttcatgcggtttaaactgttgccaggttaacgcctgaccaaccgggatcaataagccaccgcccgccccctgcacaatacgccagaaaacaaggctgtgtaaggaatcggcaaaacctgcggcagcggcggcaacgctaaacagaatgagcgaaaatatgatcagccgtcgtgcgccgagataacgtgaaagaaacgcgctaaacggaacgatcagcgttaatcctgcgatataaccgttactcacccatgccagcgccgatatggacgtatgcagatccacggacatcgcaggaaaagccacgctggcaataaacagattaatcagatcaagaaagaagccgagcaggtaaaccactgccactttactgcgatacgtcattatgcatcctccgtcagaggcgctaatgtagccgtccggagaaagccagataagtccgcgcttcaacgatatactgtcaaaataattttgacagtaaaggagctcgccatgctcaatttgcagcgtatgtcgctgtttgtcgccgtggtagatagcggcagcttcacggcggcggccgccgcatcgggccaaacaaaagcggtagtgagttttaatattcggcagcttgaaaaagagcttggcgtaacgttactgctacgttccacccgacgactgacgctcacagacgccggcgtcctcttttaccaaaaaggcgtgaatttactcaatgcagcgaaaaatttgcaggatgaagtgcgtgccagccatagtgggctgggcggcgagttacgtattaccactacgcccgagtttggcgaacaggtggtcattccggtactggcgcagtttagtcagcgccatcccgatctccgtattcggcatatgtcctcatcacatcatgccgatttaattgccgagcgctttgatgtggcgattcggcttggctcgctggcggactcccgctatcgcgccgcgctgatatcccgctttaccattctgccggtcgccgcgccgcagtggctcgcccgccaccccgtgtcgtcactggagtcgttggcccaggcggaatggattattcatgagcgattacctacgccgctacggtggacagtaacgaataatcatggccaacactcacgcctggagataagcaaagccggcaaaatttctgtcgacagcgcgcgctcgctgatggccttcgctctcgcgggaagcggcgtcgcattactgccgcaatggttagtcaacaccgcactggaggatggaacgttaattcacgtgttacccgactatcattttccccgtcagggcatttatgccgtttatccagacgcccgccatgtatcgacaaaagtacgcgcatttattgattttttacgttcgcaatgggattgcggggagcacgccccatcattgtagccagcccgggagcattgcgctcccggacggataataccgtcttaatccttaactaccagtttgtctttgatcccctgcgcctgccaacgcacccacagcataattgccgccagaacgacgattggcagtaacggatcgagccaactgccgccggaaccaaacagcaggttaatcagcgccacgccggtgccgccaatcgcccaggcaatggtcgtcggtacagaccaaaccaccatctgctgtttgacatcagagacgcccatcatgcggttaaccacccagaacaggctatcgttgaagtagccgaaaaacagcgaccccatcgttgcggcctgagcggcaagcaacatattgatgccggggatctgcgccaggatcggcgcggaaatcgaggcggcagtgatcatcgccaccgtccccgatccctgaatcagacgtaccagcgtcgccacgataaacgggatcaggatcggcgagatcggcaggttggcaacctgctccgccagctgttgccccgcgccgctgtcgcgcaggatcgcgcccaacgcgccgccagcgcccgtgaccagtaagataatcccggcgctttgcaagccctcttccagacgctctgcggtggtatgtttatccatgcgcggcaccagcgtatacaccgccagcagaacgctgatggccaacgcgatcactggacttcccacaaagttgattgcctgtaccaccggatgcgtcgccaggccggaccatccttctacagtggcgagggtggaacagatagccttcaggaagatcagcacgatcggcaccacaataggcagcagagagagcgtcaggctcggcagatccttttgctctttctctttattgtactgctccagcgcggcattaacttcatcggcgttcagcgtgcgcggcacgaaatcagggtagcgtttatccagccactgcgcatagaacacaatgccgatcacacagggcaccgccagcgccatcccggtcaataacattgcaccgatgtcgacgttaaaaatcccggctacccccagcggaccgggcgtgggaggtaccgtatggtgagtgaccaccagcccgcccgccagcgcgacgcccagcgtcagtagcgaacgtttaccgcttttcgccagcgctttcgccaccggataaagaatgacaaaagcggaatcgacgaaaatggggatgctgacaatataacccgtgatcgccagcgcccactcttcacggcgtttccccagccatttgataaagctccaggcgatacgctccgccgcgccggaaacctccagcaagcgccccatcattacgccgagaccaatcaccaggccaatgctgcccagcgtcgtaccgaatccgctggtgatgacagagagcgttttatcaatgcccattccccccaacagaccggcgatgcaggccgccgccagcatcgcgatcagcgcatgaacacgggtgcgtaacaccagccataccagcacgaaaacggcaacgatcaggccgataattggggtcggtaaacttgtcatgacctcccctccatatcatcttgtcgaaagcgttcgataatgtcatcgaagcgtttatcggcgacaaaacctaacgccagcgcacgctggttatcgatacgtcccggccaggaggcgacaattttctcgacgccttcgtcgcgctgatgcgtaacccgatcgcgcgccgcctgaccgcccgcctgacgcaacgtttccagcatctcgcccacggttacgctgatcccgggtaagttgatgctgctcgcctcgccaggcgcgggtaacgttgcggccagcgacaggttatggatcaccgtcgccgggctggaaatccacagccgcaaactttccgacaccggacagatggtcgtctcgccctgcaacggttcacgaataatcgcgctgacaaaagaagaagcggcgcggtttagtttacccgggcgaacacagatcgtcggcaaacgcagcgccagcccatccacatagcctttgcgggtatagtcgttgaccaacagttcacaggcggccttctgcgcgccataagacgagcgcggcgtgagcgcggtggtatcggtgacgcattccggcagcgtaccgccataaacggcaagcgagctggagaagacaaaacgaattttctgcggttgccgacgacacgcctcaagtaactggcgggtaagatccaggttaactttccatcccagatcgaaatcgtcttccgcatgactgctgacaatcgcagcgagatgataaacaacagaggtattagcggtaatcacattctccagtacgcccggctgggttaagtcagcttccaggcagcgtaaacgaggggaatctgataaccgtgcaggcatttttaaatcaacaagaagcagttcgttaaacgccagcgatgagtttaataaggcgcttgcgagtttctggcctaaaaagccgcccccgccggtaatgataatctgcatccggatgtcctctttattgttgtgtagggtagttcagggttagcgccaggcgttaaaccagccaagcccctcctgagtggtattccgtggttggtattcgcagcctatccagccgcaataacctacgtcatcgaacagccggaacagccacgggtagttgatctcgccatcatccggttcatgtctgtccggtagcgaggcgatttgtacatgggcatagcggcccgcgtactcgcgaatcaggtgactcaaattgccatccactttttgcgcgtggaaagtgtcgagctggatgaatacatttgggcggtcaacctcttctgcgatgcccagcgcctgatattggctggaaaagaggtagccgggtttaacgccgggactcagcgcttcgatcaaaatacgtttatcgtgggcggcaaaccggccggcggcataacgcaaattatcgataaacgtggcgcgataacgtgcgccatcagcgccatccggcacgacgcccgccatgatgtgaacctgctcgcattccagcgccagagcgtattccagagccagatcaatatcggcgcgcgcgtcgtgttcgcgccccggtagcgcggcacgtccccactcgcccgccgcggtatcacccgccgaagtattaaacagcgccagcgtcagatcatgacgcgatagctgggctttaatctcgctggcggcaaagccgtaggggaacagaaactcaacggcctgaaaaccggcttcggcagcagcggcaaaacgctcgataaacggcacttcggtaaacatcatcgacaaatcggcggcaaaacgcggcatcgggttatctccttaactgcgcaatttcttcggtggttaaataacgaatcgggcgttcgccaaggataaaaatcagctttgccgtctcttccagctcctcggtattattagcggcttcctgcaaattctccccgcacacgaccggcccatgattagccagtaaaaaggcctgatgccgggccgccagcgcagccaaatcgcgagcaattcggtcatcccccgggcgatagtagggaaccagcggaatgtctcccatccgcatcaccacatagggggtaaacgggcgaatcacattttgcgggtccagcccttcgagacaggaaagcgccgttgaccaggtgctgtgcagatgtaccacggccttgcagcaagggttattgcgatacaacgccagatgaaaacgcacctctttagacggtttatcgccgctgagccattcgccttgcgggtccactttggatagccgctgcgggtcgagattacccagacacgaaccggtgggcgtcgccagaatattgccgtccggcagtaacagcgagaggttgcctgccgagccggtggcatagccgcgctggaaaaacgaggcggctatcctgaccatctcttctcgcaaagcgtgctcttcttttgccagtatcgtcatacctgaaactccctttgagcgcggatgaaaaaggattcatcgccaaaattacctgactttagcgccagcgagactggcgcatggagcgcgttgacccacggcacgccgggtgaaatgcacggtccaatgtggaaaccggtaataccgaggctttgcgtcaccacgcccgaggtttcgccgcccgccacaataaaccgggtgataccgccttccgctaagcgagcggccagcagggaaaagagcgcctctaccgcatagctggcttcggtagcgccatattgctgctggatggcagccagcgcctgcgtggaggcggtggcgctaatcattggcgccagttcgctgtcctgactgaacacccactgcgccagcgcttcggcgtaggcctcgcgcgcctcggatgacaggcagcgcgccacgtcaacgtcgcgtgtgggagcatgttgtcgatagaaagccacctgctgattcgtcatttgcgaacaggaaccggaaagcactaccgcgcgaccgctcagcggatagcctgcggaacgggcctgagaaacgccgtgcttcgcccactgacgcgccagccccattgccagcccggaaccgccggtcaccagcggggcatcacgcaaaacctcgccctggatttccaggtgccgctcattgagcgcgtcaagtaccgcgtagcgatatccttcctgctgtaaacgcgacagcgccgcacgggtcgcggcaacgccttcatcaagcgtctgagccggaataacgccgcagcgcccttgcgcctgcgcccggtgtatcgctgatgcgataaacgttgctggcaacggcgtccagcacaggcttcaggcgggtaaacgccgcctcgcgcccggaggccatcaccgtccgccctgcgccgcttttaccgcgccgccggaaaccggcgcatccagcatgttaagattcaatgccgtcaacgccgcggcgatctcttgcgcgtcggcgcttgagatcgtagacgaaaccatcaccgcgcttccgggtttcatcagatgggcgacgccatcctcaccgaataacacctgtctgacctgggcggcattgacgaccagaatgactaacgcatccacgacgccggcgaactccctggcgctggcggcagccccacaagccccttcagcgagcagattcgcgcacgcttgcgggttaagatcggccccccatgtggaaagcccggcgcgcaggcatgaacgcgcagcgcccattcccattgagccaagccccacaatgccgacatgaaaatcagttcctgttgtcattatcactccatgttaatttacgtgatattatgttttgttatgtgaatataggcgtttttgtaaacaattgcggtgagttgtttcacaaaaaataacaaaatatgttattttttgtgaaggcaatcctcatagaacttcacacgctgtgacgagaaatcgcgtaaaatcgcgacaggactaaagaaaggagcagacgttgatacctactgagcgtcgacaaatcattcttgatatggtggcggagaaaggcatcgtcagtatcgctgaactgaccgagcgcatgcatgtatcccacatgactatccgccgtgatttacaaaaactggagcagcaaggcgcggtaatccaggtctctggcggcgtgcaatcatcgactcgcgtggcgcacgaaccctcgcatcagatcaaaaccgaactggcgacgccgcagaaagcggcgattggcaaactggccgccagcctggtacagccagaaagctgtatctaccttgatgcaggtacgaccacgctggcgatcgccaggcagctggttacgatgaataaacttacggtggtgaccaatgatttcgttatcgccgattacctgatggacaatagcggttgcacaattattcacactggcggggcggtatgccgggaaaaccggtcgtgcgtcggtgaagccgcggcgacgcttttgcgcgggctgatgattgaccaggcctttatttccgcctcttcctggagcgtgcgcggtatttcaacgccggcagaagataaagtcacggtgaaacgggccgtcgccagcgccagccgccaaaaaattctggtgtgcgacgcgaccaaatacggccaggtcgcgacgtggctggcgttatcgctggcggaattcaaccaaatcgtcaccgatgacggcctgccggaaagcgcaattcgggcgctggctaaagtggatatctcactgctgatggccaaacaatagcgaagcggcgcaagccgcttacgtcatcatcttgcgaaccagttgcgtaaactgttcgcgttcttcagcgctcagtcgccccaaaaactcatcgtcaacgcgatcccccagtggtatcgcggcggcgagcaacgtttggccctgaacggtgagatagacaaaacgccgacgtttatccagcggatcgttttctcgctttaccagcccacgattttccatccggcttaacatctccgccagcgtcgctttagtgctgaccgccgcttcggtcagatcgacctgttcaatacccggatgttcagcaataacgcgcatcaccgcatattgaggtttggtgagctccggtagttcatgctgccagcgtgcggtatgttgctgaaaaagttggcgtaacagatgaaacgcggtgtttcgtaactccatgagcgctccggataaattaactttttctatcataacgacttatgcacggttttttaatgacgaatgctttagctaaacgtgcgcaggcatcgggagcgatcttgtcgcaaaggccgtgtgggcgtattttgatcaaaatgttcgtatacgaacgatatttgaggtaagaaatgagattgattgtggggatgaccggtgcgaccggcgcgccgcttggcgtcgagctactccaggcattgcgggcgatacctgatgttgaaacgcatctggtaatgtcaaagtgggcgaaaaccactattgaactggagacgccctacacgcccgctgaggtagccgccctggcagattattgtcatagcccggccgatcaggcggcgaccatttcctccggctcatttcgtaccgacggcatgattattatcccctgcagtatgaaaacactggcgggggttcgcgccggctatgccgatgggctggtgggacgcgctgccgatgtcgtgttgaaagagggtcgcaagctggtgcttgtgccgcgggaaatgccgctcagcacaattcatctggaaaacatgcttgcgctttctcgtatgggggtggcgatagtgccgcccatgcccgcgttctacaacctgccgcaaaccgttgacgatattatccagcacatcgtggcgcgcgttctcgaccagtttggtctggagcatacgcgcgcgcgccgctggcaaggactgcgacaggcagcaaatttttcacaggagaatggataatggcatttgatgatttgcgcagttttttacatgcgctggatcagcagggacaactgctgaaaatcagcgaggaagtgaatgcggagccggatctcgccgccgctgccaacgcaacgggacgaatcggcgatggcgcgcccgcgctgtggtttgacaatattcgtggttttaccgacgcccgcgtggcgatgaataccatcggttcctggcagaaccatgccatctctctgggtttgccgcctaacacgccggttaaaaaacagatcgatgaatttattcgccgctgggacaattttccggtagcgccggaacgacgggcgaatccgggctgggcggaaaataccgtcgacggcgacgcgatcaacctgtttgatatcctgccgctgtttcgtctgaacgacggcgacggcggattctatctggataaagcctgtgtggtatcacgcgatccgctcgatcccgataacttcggcaagcagaatgtcggcatctaccgtatggaagttaaaggcaagcgtaagctgggtctgcaaccagtgccgatgcatgatatcgcattgcacctgcacaaagccgaagagcgcggggaagatctgccgattgcgatcacgttgggtaacgatccgatcattaccctgatgggcgcaacgccgctgaaatacgatcagtcagagtatgaaatggcaggcgcgctgcgtgaaagcccctatcctatcgccaccgcgccgctgaccggttttgatgtaccgtggggatctgaagtcattcttgaaggggtcatcgaaagccgtaaacgtgaaattgaagggccgttcggcgaatttaccggccactattccggcggtcgcaacatgaccgtggtgcgtatcgataaggtctcttaccacagcaaacccatttttgaatcgctctatttggggatgccgtggacggaaatcgactacctgatggggccggcgacctgtgtgccactgtatcaacagctgaaagccgaatttccggaagtgcaggcggtaaacgctatgtacacccacggcttgctggccatcatctcgaccaaaaaacgctacggcggctttgcccgtgcggtgggcctgcgcgcgatgacgacgccgcacggtctgggatatgtgaagatggtgatcatggttgatgaagatgtcgatccatttaatctgccacaggtgatgtgggcgttgtcgtcgaaagtgaatccggcaggcgatctggtacagctaccgaatatgtccgtcctggaactggacccgggttcaagcccggcggggattaccgacaaactgatcattgacgctaccacgccggttgcgccagataaccgtggtcactatagccagccggttgtggatttaccggaaactaaagcctgggctgaaaagctgaccgccatgctggccaaccgtaaataaggagtaaccgatgatttgtccacgctgtgccgatgcacatattgaactcatggcgacttcgccggtaaaaggagtctggacggtatatcagtgtcagcattgtctgtatacctggcgcgataccgaaccgttacgccgtaccagccgcgaacactatccacaagcgtttcgcatgacgcaaaaagatattgatgacgcgccaatggtgccgagtatcccgccgttgctggcagaagacaaacggtaaaaaaaaggccagtctgtcgactggcctttttttgacaagggtacttactcgcggaacagcgcttcgatattcagcccctgcgtctgcagaatttcgcgcagacggccgcaggccttcaacctgaatctgacgaacacgttcacgcgtaagaccgatttcacggcctacatcttccagtgtcgcagcttcatatcccagcagaccgaaacggcgcgccagcacttcacgctgtttggcgttcagttcgaacaaccatttgacgatgctctgtttcatatcgtcatcttgcgtggtgtcttccggaccgttctctttttcatcggccaggatgtccagcaacgctttttcggaatcaccgcccagcggggtgtctaccgaggtaatgcgctcgttgagacgaagcatacggctgacgtcatcaaccggtttatccagttgctctgcaatttcttccgcactcggttcgtggtccagtttatgcgacaactcacgtgcggtgcgcaggtatacgttcagctctttaacaatgtgaatcggcaagcgaatcgtacgggtttggttcataatcgcccgttcgattgtctggcgaatccaccaggttgcgtatgttgagaagcggaacccgcgttccgggtcaaacttctcgactgcacggataagccccaggttgccctcttcaatcaggtccagcaacgccagtccacgattgccataacggcgggcaatttttaccaccagacgcaggttactctcaatcatgcgacggcgagaagcgacatctccacgcagtgcgcgacgcgcaaaatagacttcttcttcggctgttaacagtggtgaatacccaatctcaccaaggtaaagctgagtcgcgtccaacacacgctgtgtggccccttgcgataacagctcttcttcagccaggtcgttatcactgggttcctcttcactcaaggctttttcgtcaaaagcctctactccgttctcatcaaattccgcgtcttcatttaaatcatgaactttcagcgtattctgactcataaggtggctcctacccgtgatcccttgacggaactagcaagtcaaagcctggttccgccgctttatcgctgcggtaaataacgcagcgggtttacggatttccccttgtaacgaatttcaaaatgcaagcgtgtagagctggtgccggtgctacccatagtagcgattttttgccccgccttaacttcctgttgttcccggaccagcatcgtatcattatgggcgtaggcactcaggtaatcatcgttatgtttgatgataataagattaccgtaaccacgcagtgcgttaccggcatatacgacgcgcccatcagcggttgcgacgatagcctgtcccttactgcctgcaatgtcgatccctttattgcccccttcggaagcgccaaagttttcgatcactttgccatccgtcggccagcgccatgcggaaatcggcgcgctggttgacgtactgcttgcatttggttcggtcgtgcttaccgttggtgccgttacaggcgctgtgacaaccgtcccagcaggcttgttgtttggcaacattttgttagcactttgttcacctgagccctcagaatacgtaattgttggttgagacgcaactgcaacggtggaattttgtgcagacctggtcacaactccttgctgtgctgcatccgcctgggtgatcgcatttccgccagtaattggcgtaccggatgcgttaccaacttgcaaagtttgccctacattcaggctatacggggcagaaatactgtttctctgggccagatcgcggaaatcattcccggtaatccaggcgatgtaaaaaagcgtatcaccctttttcacggtgtaagtactgccgcccgtatagctacctttcggaatattcccatactggcgattgtatacgattcgcccattttccatctgcacgggttgttccgtgaccggttgagtttgcatgggctgcgttacaggacgctgaacgggttgaatttgcggcgcttgttgcggcgtcgcgcccatttttggcggcggtgtgatcaacatcccggaattggtatttgatgacgacccactgtccacagacgtgaccggcgccggagggtttgacgaactggtacaacctgccagccatagtgaaaccagtgatagtgccgcaatgcgactaacggtgaattttgggcttcccgcgctcatttatcccccaggaaaaaatttggttaacaaccagtgacgtaagaaccgtgcaacgcattaagtgaacacgggaaaatgtgttcacgatacgcttaacccaccgggaataaccaggaaaactccaggtattcgtttcggcttcatcaggcgtaatagtggctgtttgcagggcaaactaggccagctctcccttgactaacgggacgaagcgaacggcctccacggtatcgataataaattcgccgccccggcgacgcacgcgtttcaaaaactgctgctcatcgcccacaggcagaacaagaatgccgccttcatccaactgtgccatgagcgcggtaggaatttccggcggcgcggccgtcacaatgatagcgtcaaacggcgcacgcgcctgccagccttgccagccatcgccatgacgggtagaaacattatgtaaatcgagctgcttcaggcggcggcgcgcctgccattgcagccccttaatccgctcaacggagcaaacgtgatgtaccagatgcgctagaatcgccgtctgatagccggaaccggtgccaatttccaacaccctggattgcggcgtcagttcgagcagttccgtcattcgcgccaccatatagggctgcgaaatcgtctgaccctggcctatcggcaaagcgatattttcccaggccttatgttcaaacgcttcatcaataaatttctcgcgcggcactgcggcaagcgcattaagcaccagctcatctctgatgccctgcgcgcgcaattgttcaagaagagcctgtacacgtccacttaccattgcgtgccaactcccacgctgtctaaccagtctgaaaccacatcatgcgcgctgtgcgcggttaaatccacatgcaacggcgtgacggagacgtagccttcatccaccgccgcgaaatcggtatccggcccggcatcgtatttatcacccggcgggccaatccagtacaatgtattaccgcgtggatcttcctgcgggatcactttatccgctggatggcggctaccgcagcgagtcacgcggatgcctttaacctgcgctaacggtagatccgggacattcacgttgagaatacgcccggtacgcaacggctcccggcttaaccctcgcaaaagcgcgcaagtcacggctgcagccgtatcataatgctgatagccgttaagggagaccgctaatgccggaaagccgagatgacgaccttccatcgccgcggcgacagtaccggaatagatcacatcatcgcccagattcggacccgcgttaataccggaaacgacaatatccggacgcggacgcattaaggcattaacgcccagatagacgcaatcggtcggcgtccccatctgtacagcgatatcgccattatcaaaggtaaaagtacgaagcgaagattccagcgtgagggaattagacgcgccgctgcggttacgatccggggctacgacctgtacatcagcaaactcacgcagcgctttcgccagcgtttgtataccgggcgcgtgaaccccgtcatcgttactcagcaatatgcgcataatcacccattgtgttgatcagttcccttactacgctggtggcaaaactgcctgcgggcagccagaaacgtaactcgacggtaacgtcatcccaccagttccagcttaattgttgcggataaagcagcatcgctctgcgcgacgcctctactttttcgcgcagcaacagcgattgcaacaccgtttcctgggcaatggcatcttgctcaaacgccagcgccgcacgctgtgttccccactctccgctgcccggcaacgacgctgtaatcatcagctctttttcgtctacccggcgctgcaattcaggcagttcttcagatgtcgcgacgaaccagcttccacgccccgctaattgtagcgcatcgccgtcaacaacttgattaaagtctggtttcttcagccgctggtgaacaatttgattaaacaacgcgctacgcgccgccgacaaccaaaaactgcgtttattgcgatcgcgcaccggcgcgttactttgcgcccagcgcagcgcgccctgcaagttgctgccgccaatgccgaatcgttgtgcgccaaaatagttcggcacgccgccatcgcgaatcgcctgcaatcgtgtttcgacatcgcggcgatcgcttatttcacgcaataccagcgtaaaggcattgcctttcagcgcgcctaaacgcagcttacgcttgtgacgcgcgtattccagtactttacaaccttccagctgaaaggcgctgaaatcgggcatctctttccccggcacgcgcgcgcacagccactgctcggtaacggcgtgtttatctttttgcccggcaaagctcacttcgcgagcgtgaattttcaggaatttcgccagcacgtcagcgacaaaacgggtattgcaaccgtttttcaaaatacgcagcagaatgtgctcgccttcaccatccggcgtaaagcctaaatcttcaaccaccacaaaatcttccggattcgctttcagcaatccgctaccttgtggttttccgtgcagccaggtgagattgtcaaactctgtcatttcgccgccttcatcagcaacgccaccgcttcgcaggcaatgccttctccgcgtccggtaaatccgagcttttccgtcgtcgtcgccttcacgttaacatcatccatatggcagccgagatcttcggcgataaagacgcgcatttgcggaatatgcggcagcattttcggcgcctgcgcaataatggtgacatccacgttgccgagggtgtatcccttggcctgaatacgacgccaggcttcacgcagtagttcgcggctatccgctcccttaaatgccggatcggtatccgggaagagcttgccgatatcgccaagcgccgccgcgcccagcagcgcatcggtcagcgcatgtaacgccacatcgccatcggaatgcgccaatagccctttttcataagggatacgcacgccgccaataataatcggcccttctccgccaaacgcgtgtacgtcaaaaccgtgtccaattcgcattatgctttctcctggtggatggttcgggtcagataaaattccgccagcgccagatcttccggacgggtgaccttgatgttatccgcgcgaccttctaccagcgccggatgaaaaccacaatactccagcgctgacgcctcgtcggtgatggtcgcgccttcattcagcgcacgcgtcagacaatcgtgcaagagttcgcgggggaaaaactgcggggtgagcgcgtgccataaatcggcgcgctctacggtatgggcaatagcgtttttccccggttcgccgcgtttcatggtgtcgcgcaccggactggcgagaataccgccgacccggctgttttcgctgatggccagtaaccgcgcaaggtcatcctgatgcaaacagggtcttgccgcgtcgtgcaccagcacccactgcgcctttgcaacggcctgtaacccggccaaaacggaatcagcgcgttcgttgccgccatccacaacggtgatttgcggatgattcgccagcggaagttgggcaaagcgatgatcgccagggctgatagcaataacaacgcgtgtcacccgaggatgcgccagcagcgcatgaactgagtgctccagaatggttttattaccgattgagagatactgcttaggacattctgtttgcattcggcggccaaatccggccgccggcaccacggcgcaaacgtccaataaagtggctgccatgttaaatccctggatggtttatcgatgagtttgccccgccgttgccgcgcgttttgaggcgtcaggcaccagacgatagaaggtttcgcccggtttggtcatgctaagttcgttgcgcgcgcgctcctcaatcgcttcctggccgccattgagatcgtcaatttcggcaaaaagctgatcgttacgcgctttaagtttggcgtttgtcgcctgctgcgcgaccacatcatcgttgacgcggctatagtcatgtatgccgttcttaccgaaccacagcgagtactgtagccagaccagtaaagccagcaacagcagcgttagtttacccatcctgccccctgaaaaacggcatcatcatcccataacgtcctctgtgactccacattcaggacgggattgccgcgacaacgccggcaaatgtaccacatttgccggatgttacgtatacccgagtaaggagaacataatctcattgttggttacggtttgaattatgaccggaggcgcagtgataacccgtctaccctaatagccatatgaataacgcgccgaacagcgcgcctacggccagtagagtaaacatgatgctaaaaagtattttgccctttaccaacagatgcaacgcaatgccgataatcaccgataccggcattaacgcgaggaaaaagggccaagtatagaggaaaaaaaacagcgtgttagggccataaagcagaaaagggatccccaacgccagcagccatgacacaaagccgaccaccgcccccggaaatgcactggtggcgtcatcgtcgaccatgaaggcgtctgaccttgtgaaagtaatgttatggctattacgcatattaaatcctgtaaccttgaccataccgggcatacaagcccggtggtgtctcaggatctgataatatcgcgccgtctcagcaggtctaataattgggaaaccaaatttgttactaattgttcaccattaagatgaacctggggcgagtcaggcgcttcgtaaatggcgtcgataccggtaaagttacgcaactcgcccgcgcgcgcttttttatacaatcctttaggatcgcgctgttcacagatagccagcggcgtattgacataaatctcgataaaacgatcgtggccgacgcgctcttttaccagttgccgctcggcgcggtgcggagaaataaatgccgtcaaaacaatcaggccagcgtccgccatcagactggccacttcgcctacccgccgaatattttcctggcgatcggcatcgctaaagcctaaatcacggcacaaaccgtggcgcacattatcgccatccaacaggtaggtactgacgccacgctgatgtaacgcctcttccagcgcgccggccaccgttgattttcccgaaccggagagtccggtaaaccacagcaccacgccacggtggccgtggagctgttcacgagcggcgacagtaacgggatgagagtgccagaccacgttctcatcatgcagcgccatgtttatctcccagcaaatctcgggcgtcccagtgcggaaaatgacggcgtaccagcgcattcagctccagctcaaacgcactgtattccacgggcggcgtcgctccgcgttcatccagttcccgcaccatgccagcacccacggtaacgttagaaagtcggtcgataaaaatcagcccgcccgtcaccggattttgctgataaatatccagcgcgagcggctcatcgaatgtcatctctaccagaccaataccgtttaacggcaggctctcgacgtctcgttgagtcagattgttgatatcaatctgatagcaaatagcctcgatacgcgcgcgggttttcttacccgcaagtttaacgtcgtagctttggcccggcgccagcggctgttccgccatccataccacatcgatcgcggcgtgccgcgcaggtgccagcgtctcgtttgccgccagcagcagatcgccgcggctaatatcaatgtcgtcgttgagtaccagggtaatggcttcgcccgcacagacttcttctttgtcgccatcaaaagtgacgatacgcgccacgctggattccacgccggacggcagcactttaatgcgctctccgactttgacgctaccagacgccagagtgccggcatacccccgaaaatcagggttcgggcgattgacgtattgtactggaaagcgcatcggctgacggtctaccgcacgctgtatgtctaccgtttccaggacttccaacagcgtcgggccgctgtaccagcgcatattggcgctctgcgcggcgacattatccccttccaacgccgaaagcgggacaaagcgaatgtccagatcgcccggcaactgttcagcaaaggtcaggtaatcttcgcgaatacgggcgaaggtctcttcgcggtagtcaacgagatccattttgttgattgccaccaccaggtgtttgatccccaacagagtggagataaagctatggcgacgcgtctgatccagcacgcctttacgcgcgtcgatcagtaggatcgccagatcgcaggtggacgctccggtcgccatattacgggtatattgttcatggcccggcgtgtcggcgataataaattttcgtttttccgtggagaaatagcggtacgcgacgtcaatagtaatgccctgctcacgctcggcctgcagcccatctaccagcagcgccagatcgagtttttctccctgcgtgccatgacgtttactgtcattatgcagagaagagagctgatcttcataaatttgcagggtatcgtgcagcaaacgacctatcagcgtacttttaccgtcatcaacgctgccacaggttaaaaaacgcagcaggcttttgtgttgttgggcaatcatccaggcttcgacgccgccttcactggcgatttgttgtgcaagtatggtgttcatggcggctccttagaaatacccctgacgttttttaagctccatcgaccccgcctgatcgcggtcaatcatcctcccctggcgctcgctggtggtagaaaccagcatctcttcgataatttccggcagcgtttgcgcgtgggattccaccgccccggtgagcggccaacagccaagtgtacggaagcgcaccatcctttttttgatgacttcgccaggttggaggtcgatacgatcgtcatccaccatcatcaacatgccatcacgttccagaaccgggcgttcagcagccaaatacagcggcacgatgtcgatgttttccagccagatgtattgccagatatcctgctctgtccagttggagagcgggaagacgcgtatactttcgcctttattaatctgaccgttatagttacgccacaactctggccgctgatttttcgggtcccagcgatggaaacggtcacgaaaggagtaaatacgttctttcgcgcgggatttttcctcatcgcgccgtgcgccgccgaacgcggcatcaaaaccgtacttattcagcgcctgctttaacccttcggttttcataatgtcagtgtgtttagcgctaccgtgaacgaacggattgatgcccatcgccacgccttctggatttttatgtaccagcaattcgcagccgtatgcgttggcggtacgatcgcgaaaggcgtacatctcacggaatttccaaccggtatcaacgtgcaatagcgggaacggtaacgtacccggataaaacgccttacgcgccagatgcagcatgacgctggagtctttaccaatggagtacagcatgaccggattagcgaattccgctgctacttcacggataatgtggatactttccgcctccagttgccgcaggtgggtgagtcgtttttgatccataaccgttcctttgcaataccgttttttgctaaacatttcgattacacgactatagggagcgcgggagagtgaatgaaatgacgaattggaatgagtagttcctcaaaggaataacgcggcccaaaaaccaatatcaaaaaatgcttaacgtaccggattgccagcatttaggagcaaatgaaattgtattaacacgatcgcggtttcatactagccccgtaaaattttgttctgtatttaaggactcattatgttttccgcaacgcgccgctttgccgtcattctggcgctcggcgtaggctttatccttcctgcacaagcagcatcaccagggcctggtgaaatagcgaatactcaggcacgacatatcgccaccttttttcccgggagaatgactggctcccccgccgagatgttgtctgccgattatttacgccaacaatttacccagatgggataccaaagcgatattcgaacgtttaatagccgatttatttataccacgaaggataatcgcaaaaactggcataacgtgacgggcagtacggtcatcgccgcccatgaagggcgcgtgccgcagcagatcatcattatggcgcatctggatacctacgctccgcagagcgatgctgatgtcgatgccaatctgggcggtttaacgttacagggaatggatgataatgccgcgggattaggcgttatgctggaactggcggcgcgtctgaaagatataccgacccattatgggattcgttttatcgccaccagcggggaagaagagggaaagctaggcgcggaaaatttactcaaacgaatgagtgacgctgagaagaaaaatacgctgctggtgattaatctcaataacctgattgttggggacaagctctattttaatagcgggaaaaatacgccggaagcggtgcgtacactgacccgcgatcgggcattagcgattgcgcgccgttatggcatcgccgccaacaccaatccgggacgcaatccatcctaccccaaaggaacgggttgctgtaatgatgcggaggttttcgataaagcgggaatatcggtgctttctgttgaggcgacgaactggaatctgggtaaaaaagacggataccagcaacgtgtgaaaaatgcatccttcccgaacggcaatagctggcacgacgtacggcttgataatcaacagcatatagacaaggcgctgccagggcggattgagcgccgtagccgcgatgtagtgcggataatgctgccgttggtaaaagagctggcgaaggcggaaaaaacgtcctgatatgctggtgaaacgtgtttatccccgctggcgcggggaacacggacagcaacccgtgtcggatatcagacagatcggtttatccccgctggcgcggggaacacacgcgaatcgccaatcgccgccgcgtgaattgcggtttatccccgctggcgcggggaacacccacgatgtatgccgaccgtgatttttaccgccggtttatccccgctggcgcggggaacacagatacgcctttacgtcgccctctttggcgcgcggtttatccccgctggcgcggggaacacattaaaaaagattaatgttggttatagttttacggtttatccccgctggtgcggggaacactaaaacaccggttgcgcaacctccgcggggatcggtttatccccgctggcgcggggatcggtttatccccgctggcgcggggaacactctaaatctacccaattgaatttaaatacttttttagcgcacaaaaaacccaccaacttttcctaatttttaaagatctctaacttattgattttcaacaggtagaaacgacaccaatcgcagtccatcaagatctaccggaatacgtcgatttacaccaaaagtctgaaactcaaaacctgattctgtatttgtcgcccacgccataacaacatttccctcatctgccagaacggaaacctgttgccatatcatctcgcggatctttgcggaaacatcaccaacatacacaccagctcgaatttccagtaaccagacggccagcctcccccgcagacgaggaggaacattttcggtaacgacaaccagcatactcatcgttaggtactccgatgaccggaatctcccaacgcaacaggaagagggatcgctatggggtgtgaatcttcaggaggtaacggcggttgaatttcccctgccgcgagaacatcttcaataagaggaatcaatttcgccaatgtttttccactgcggaagatatcccggcaggcaatacggacatcacgatcgggctcggcaggattacgtcgcgcaatttcaaatgctttcggtacaacgatctcaaatttaatgatatcggcaatatcatagacaaaagaaagcggcttgccggtgtgcacaaatccaatcgcgggcgcatatccggcagccagtattgccgcctccgttacgccatagaggcaggaggttgccgagctgatacactgattaatgacatcgcctttctcccagtctttcggatcgtagcgacgtccctgccatttcacgccatactgcttagcaagtagtgcataggttgcccgcacacggctcccctcaataccacgcaattgatctacagaacgacggctcggcgcgggttcgccaaaacgtaattcaaacattttacgcacgaccttcagccgcaaatcttcatccagtgcaagtttcgcctgataaagcaatttgtcggaacgggcaccaccaggctgccccgaagcgtaaacgcgtacgcccgcttcccccccccacaccagtaacgtacccaccgttgccgcaagtcgcacggcggcatgggaaacccgcgtccccggttccagcatgatgcaggccaccgatccaacaggaatatgggtacgtacacccgttttatcgataagcacaaacgcaccgtcgatcacatcaatttgtccgtactggagaaatatcatcgaaacacggtctttcaacgggatgggattcagcggcagccagctcatcagcgtttcctttttaccatcagcattccgcagcccagcgctttacttttacctaatccggaaaataaagcctgtttaaacagtgctgcatcggtgatacagagcgcaccgctaaaatcaacgctactgaaagtgattggggtttcctggtctttacggacaaaacgatgttgctgatacgcttgcacgcatccacaatgcgcctgcaattcactgtactcgtcaccagcccacatagcgaaatcatcaggttccggtgcaatcaaccggaaaccatgctgctgcccttgttgttccagccacgcctgcgcggcctgctgttgaagctcccaccaccgttctttctccacaccattcgccttcgcctgatgtttcgcgttcatcatcacgtcactgcgcttaccgttacgggttatcaccgggttagctcgtagttgaaaatcaagctcaagaccatttgtcagttgcggattaaatagtttggtttcaataagaaacagggagtgctgcaataacggcggtattgccgagagcataaaaaagccgccatgcgcctcttcgcgaaacagaaactgacgcaattcctgttccggaaagagctgccataaccactggtggctggcataaggcctggctgaattccactttgccaacatctccggtcgcaaattattaaaccggagttgaatacgagaaagatacattatgttctctcctgcaacggcccattgaagcgggtgtagccgccaaactgccagcgttggcggctaactggctggttattgctatgctgcttttgttgccagaccagactctcctcatcaggatcatcccaataacaaataccctcacgcagggtaaatccacttaattccgctgcggaaatctcctccacagcatgagtgaatacctcttttaaggtgccggtcattaaacgcgccgctaacggtaacgccagcgggcaggattttctccccagatagagcggaaaatgcggtgtcagcagcgcctctcgcaattcgctaagcgaatatggtgcatcaggcgtggcgcttattgccacatgccagtagccatcgcagcgatactctcgctgcgagataagcgttcccacttcatccgacgcgagagtcagttcatcccggcgcgtgtaataacgatactttttgttttctcgcggcgcgctaaccgtgtgataatcccgcaaccagcgatcttgtgaagccaacgcgtgcaccgccagatgatagtgccggttaaagttattcagccgcgcttcttcgtcgcgacgaattcctaacgctgcggcaagcagacccaatagcgcagagcgcgtgggaaccgtagctgagtggcgaatctcgccagacgcttcctccccccacgacgccagcggcgcataaagctgaaaaaccagatattccttcattattcatccttactggctaacaaaggccagtaattccgccagagatcccgtaccttcctgaacgttcaactcacgataatcgtctgcacagtttccatatacgctatcgaagctggcgcgctgctgttttaaacgggttattgccgcaggaatttgatcggtatcgcgtaccggctggaaaaatgccgccgccagagaacgcggttgtttttgcccgacttcggccaacgcataggtggcataggcacgagaagcgaagctgttttgtttaccggttggcgagacggttaacgctgtttcagtgagtgccgcgatagtacgcttcgccagttcttcgttaccacccaggttttccaccagcagatcgcggctgatacagacataggtatagaaaagcgccgaggcaaaaccctgctcgcccatatgcccggaacctgcgtcttcctctttattattcagatcgtcaacggcggtgaaaaaatcagactcaacggtcacggcacttacgcccaacgcatgggatacctgacaagcagcctcgacgttgaactcaggcgatgacgccagcatacggtcaaacagcgccatatctacgctacgctgttctttgcgcagaagcttcacttcttcatcgttaggttcgcgtttgtcggcaattagcgtatcaaccagttgtttaatcaaactaatttcatggttactgacgtgaacgatctgctcaatttcgagatttttttccggtttcgcatctttatcacttttaagcttgccaaattgcttagcgattaactcagacgaactcttagcaattttttcttcaattccggcatctttcatcggacgataaacataatccacgccaattcgacgagtacgcttacccataaagccatccattgccgcttcaaaagtttccgacacccgccaggcacgcttcagactttgcgacgatacgcgtaaacgctcaactcctcccataaacgcggtcttcggtctgccagactcatcacgattcaggttagcgggcgcataagcagtcaataaatgcagttgaataaaagttgtcattatcaaatccttctaaaaatgattatttgccacgcgacgtggaaagatattcgttcgcccaacggatgcgacttcgttcaaaggggttacggaattccggctgatggttttcgcgtcgttgccactcttccatccacaggaaaatgccatcggcaagtgaaagaacattcaccccctccgtaccgcgaatcttcactgcctgaatcaacaactggcaaaatgtttccgggtcggacgctttttgcaaacgttcaaaacgcagaccagaaacgcacgacgtggaacctttaagcttttcccctaactgcgcagcgaaactaatattctccttatgactcttaatatgcacagcgacgctgacaaacagagccagagccatctcatcaagaggttgcagtcgcatatgtttaagcagagcctggcggagagcgtcatgtccttcacatatcattacgccatatggcggcgccattcttttcaactcagcccgccaggcgcgaccgttgactcgtttaccatccttgcgctcataacgctcagacagcgtagcaaaccagtcaagtagtgccttctgcgcatcggggtggagaattctgcataacactgctgtattgctattcagcatatttggcttccttctgttattcgaccagcgccaacacatccttgcgcgctttatgtttacgatagctgctggctaaatcctgtcgggccgtcagctggcgctgcaggatatcgtccgggcagtcggggttggtcagggcatcacggtcaaaaacgtgaaatagatagtgtgctaattccgcctcccactgacttactgcgtgacgagtctgtgtatcctgccgaagcggatcgacagccagcgcctcttgcaacgtccgaaaagcgggttcggtttcctgccagaaggcgatatccaccatactaaaatccattttggcttctttcggacaatcgaatttggcgctctttaacgcgttccgtaacagcgacagcgactcactagccagcaccagcacaatgttaagcgcagcgagaaattgctcttcgtgcgaaacgctaatgagcggaattcggtgctgataccagcagcggaccttggccttattcatatcccaggcaaagcaccacaggctcattttgttccgctgaccagcggcacgaacgacctttgcaggctgcattttgttgaacttatcctcacgattgagcatcagccccaaccagtctttataacttaacccgcccggctgccctttaaacgccagccagggtgcggatggatctttcaatgcctgccgatatggggagaagggatgtagccaactgtcgtactgaacgccataatttttactacgcatttgcagtagcagtgattcgtgatgctccccgcacaaatcgcagatacctgccacagtgtgggtgaaatccagttctatgcgccgcggcatcccccagtaggcttgcaaggggtgcgcattatccggtgtgaccacattccccgctttttcgctggttttcgtcggcgcaagccagggaaaaatgagtggatgctgtgtaacattcggcggctcttcctgcggcaaaacgttaagccaaagttttttccatagtggatatttatcttcttcctgcggtaccaccagcgtagtcagcggaccaccgccgcgcatccctacccggtaacccgccccgccggcaggtgaattggtttgaatcgcaaatagcgctatcgccgcgcagtgaggacatatttgttctacgttgccacgttttacaaaatgatctttattgagcttgagcgcattcccgcccggcgcatccaccagcagcccggcaatagaaccatattcactatcgagaggatcaaaactttgcaggaaggaaggtttttgctcgccgaactgtagagccagagaaatcgtatttaacgccttctcccattgttcgaattcgatactttcatgccagatatctgcccattcttctttatcttccggcgcgacggtacattgtaaaataccaatcagcatttgccatgccgccccctgaaagtcagcccgaggataggcaagatcctgaatgcggttatccagaagatcgcgtaatgatattttctttttatcgccgtttgagaatatgacgggaagccatttctctttggttaaatccatacctttactcctgcagggctatttattaagccaatttggaatattacctacctataggtagattccgtcctgaggtatctcttaaatactgtcatcggagttatactacattttctcgaagacgaaaatataaataaaaagtagatacagtcttaaatcagactatgtattttttatagttatctgttatctttaatacgttccctaaaattatgggataaaccgtagatgcagtcttaatagcgcagcgttccccgcgccagtggggataacctaatccagacaaaaaaactggccaattacccgtatcccaatttattatcgatttcattgtaatccccctcctacagaaaaaagatgacacagatagaatatctggactacctctgctattgggggaaaacagataaatcaacagaaaacataacctgtaattatcatttactggcataccattgcctggacgttgctgcatgcggggaatacataataaaaaacaatacattcaattcatgtaatatattaaaagaatgtaatatctcaggtacaaatgcagaaaactggataatctggtttcttgccagccacgatatcggaaaattcgccagaggatttcaaaaatacgccgaattcccagactctcccttagtctctcccattagcggtgtttccgcatttgagagacatgattccttaggcttctatttatggggtaaattatttgaagcgtggagttcaggtagtaatgaaattatcgcaggcattgaaccagaaaatcgcgctaggtttgaaagcgctttaaatagctggatgcttattagcaccgggcaccatggcatcccgccggacaccatgaaaaatagaagctcgctggcattcaccgatgaagacattgtcgcagcaacgcattatctggaagcattaagtgaattattccctttcactctacctcaggaatggaaaaccaaagcagggagaaaatgtttaaaacagcacagttggtttttcgctgggcttgtcaccctcgccgactggatgggctcggatgaaagccagtttccactgctcagcagcgccatgccattgaaagattattggcctctcgcttgtgaaaaagcccaacaggccatcctccgaatgccgccgttatctcagcacagccattatcaagatcaccgggcattatttccgttcattcagacgctcacccctcttcagcaacgagcaagcgaactggatatttcagcacccggtgcacagctggttgtcctggaagacgttaccggagcaggcaaaacagaggccgcactgattctgactcaccgcttaatgtcagccaataaaggccacggtctctacgttgggttgccgacaatggccaccgcaaacgccatgtatcagcgcctggcatcggcttatcatgcgctatttaccgatgagtccaggccatcgctcatcctggcacacggtgggcgagaaatgtcggactctttccgacaatccatctggcagccaacagaaaatatagctgaagattatgcccgtgatgatggcaacgcgactactgagtgccatacctggtttgcagattcacgcaaaaaagcgctgctggcggaagtcggcgtaggtacgctggatcaactcttaatggcggtgatgccttttcgccatcaatcgctccgattgctagggatgcgcgacaaaatcctgctgctggatgaagtgcacgcctatgatggttatatggttaaattgctggaaggtttattgcgcttccatgccgcccagggcggtagcgctattattctgagcgccactcttcccgccgctttacgggaaaaattacttaatgcgtttagcgatggcgcggaatttatgagcgctggtggtagcgataacgcgggttatccatggttaagccacctcacttcctccggtctgttagagcaaccactggccacacgtcccgaagtccaaaggactgtagccgttaattggatacagcagcgccaggaagcactggacattatttatcgcgttgtggcaaccggacagtgcatttgttggatccgcaacacggttgatgatgcgctggacacttaccagcagttgctacacgagggaatcgttccagagcaggatcttttgcttttccacagccgttttgcttttatcgatcgtattgctattgaaaataaaacgttaaactggtttggtaacaatgcccccgtttctgaacgacgtggtaaggtattaatcgccacacaagtcgttgaacaaagtctcgatctggactttgactggatgatcaccgatctggcgccgattgatttattgatccagcgcgccggtcgcctgcaacgccatatccgcgatgcccatgggcaacgaaaatctacgcttccggatgaacgccagccaccagtattgcatatttctggcccctcactggcaggagcaggcagaagagggctggttggggcaagagctaaaaggtaccggctttgtttacaccgatcatgcctgcctgtggcgtacccaggcgctgctgcgtcaacatggtgagatccgtatgccggataatgccagagcactcgttgacggcgtatacgagcagaaaattgctgcgccagcaggcttgcagacgatctctgacgttgcctttggcaaagtccttagccaacgttcagtggctgcgcaaaatttattacgttacgatctcggttacgatcgagaagccagcgactttttatgggataaagatagagaattttctacccgtctgggtgaagagagtgttgatgtttatctcgccagaaaagacattgatggacagctacgccctttagttgatgaaatagatttctgctgggaaaaaagtcgcttatccgtccgaaaatcatggtggcaaaaaaattctggtacattccaatgtccagatgaggaaacattagcctgtttcagaaaacgccaccatcgcccttccggacagattgtgctggtatctgataccggagaagctagctattacagtaaacgttttggattggttggataacgggtattattctaactccgttgtatagagaagttattacattagattcactaaaatctttgtagcttctctatctatatccatttccatgaatacccttaattaaatttaactacttcatttcatcatactttatctctcagcatcaacaccatccatgacaaaccaaaattttaaaaaaacgaccatttgcggcgaatcatctaccttttgtctgaattatcgtcaccacaaaggattaccaaccataaatgtgctgtattgataatgccgttcacattctctcctgtagtaaaccttgtctgtttaataaaaaagagcgaattgaacgatatattttactccggatattgaataatataaatttgaaggaaaatattatgccagtcactttaagcttcggtaatcatcaaaattatacgcttaatgaaagtcggcttgctcatctgttaagcgcagataaagaaaaagcaatccatatggggggctgggataaagtccaggatcattttagagcggaaaaaaaggaccatgcgctggaagtgttacactccatcattcacgggcagggccgtggtgaacctggagagatggaagttaacgtagaggatatcaataaaatttacgcctttaaacggctacaacatctggcctgcccggctcatcaggatctgtttactatcaagatggacgcttctcagacacaatttttacttatggtcggcgacacggtgatcagccaaagcaatattaaggacatcctcaatatatcagatgatgcagtgatagaatctatgagtagagaagagagacagttatttttacaaatatgcgaggtgattggtgcgaagatgacctggcacccggaattacttcaggagtcgatttctactctacgaaaagaagtgacgggcaatgcacaaatcaaagcggcggtttatgagatgatgcgtcccgcagaggctccagaccacccgcttgtcgaatggcaggactcgcttactgaagatgaaaaatcgatgctggcctgtattaatgccggtaactttgagcctacaactcagttttgcaaaataggttatcaggaggtacaaggtgaagtcgcttttagcatgatgcatccgtgcatctcctatttactacatacctattcaccgtttgcagagtttaaaccaacaaattccggttttttaaaaaaacttaatcaggattataacgactaccatgcaaaaaaaatgtttattgatgtaattcttgaaaagctatatctaacgcatgaacgttctttgcacattggtaaagatgggtgcagtcgtaatatattactgacataaagatagccagtaatataaccaatttaaaatccggctgcctgccggattttacatagcagcaagtataatcataccgcgtaaggacaattacccttcatgcagcccgcactcacgtttcagtccgaagaagcgtgtctcttcttccgccatacccggctcccatttgcgggtggtgtgcgtatcgcccaccgacagatagccctgagcccacagcggatggtatttcagaccgtgcttttgcagatactggtaaaccgtgcggttatcccagtcgataatcggtagcactttaaacacgccgcgctggatagcgagaacgggtaaatgcgcgcggctaccggactgctcgcgacgcagacccgcaaaccaggtctgcgcgtttaactctttgagcgcccggttcatcggctcgactttgttgatctcattgtatttctcaatgccctcaacgccctgctcccacagcttgccgtagcgcgcttcctgccaggccggactttcgcccgcgcggtaaactttcaggttgagtttgagtttgtccgttagctcatcaataaactgataggtttccgggaacaaatagccggtatcggtgaggatcaccgggatatccgggcgaatctggttcaccaggtgcaggctcaccgccgcctggataccaaagcttgaggagagcacgtattcgccgggcagattttccagcgcccaagccacgcgttcttcggcagtcagcgtttccagttgagcgttggtttccgccaacgccagtacgcgatcgacttttggcagttcattcaatgcgttgagatcgagttgggacataagttcctcactgtttgccttgcctgatggcgctgtgcttatcaggcctacacagacgccatccggcaattcaggttattcccagaaatcacgcgcgggatcgagcaccgggcgaatgatgcccgcacgcaccgtaaagtcgccgaagccttcacccgcttcacgctctttcgcccagcgcccaatcagttcatccagcgaagcctgaatatccggctcggtgatattttcttgatacatccgtggaatacgactcccgatgcggttgccgccaagatgcaggttataacgaccaggcgctttccctactaagccaatttccgccagcatcgcgcgaccacagccgttcgggcagccggtcacgcgcatcacgatatgctcatcaggaatgccgtgtttttccagaatcgcttccactttgtcagtaaacgacggtaggaaacgctcggcttccgccatcgccagcgggcaggtcgggaacgacacgcaggccattgagttttcacgctgcgcgctcaccgcattcatcagcccatgatcgcgcgccagtttctcgatcttcgctttctggctttccggcacgctggcaataatcaggttctggttagcggtaatacggaactcgccctgatgaatcttcgcgatctccagcaggccggttttcagcggacgccccggatagtccaggatacgaccgttttcgataaacagcgtcaggtgccatttatcatcaatgcctttcacccagccaatcctgtcgccacgcccggtaaattcatacggacgaatgggttcaaatgtgatccccgcgcgacgctcgacttccgctttaaacgtctccagtcccacacgctcaagggtgtatttggttttggcgtttttacggtcggtacggttaccccagtcgcgctgcgtagtcaccaccgcttccgccaccgccagggtgtgctccagcggcagatagccaaactcgctcgcggtacgagcgtaggttttcttattaccgtgctcaatagacagaccgccgcccaccagcaggttaaagccgaccagcttgccgttctcggcaatcgccacgaagttcatgtcgttggcgtgcagatcgatatcgttttgcggcgggatcactaccgtggttttgaacttacgcggcagataggtctgtccgaggatcggctcttcatcggtggtcgccaccttctcctgatcgagccagatctccgcatacgcacgagtgcgcggcagcagatgttcggagatcttcttcgcccattcgtaggcttccgcgtgcagctcggactcatacgggttagaggtacacagcacgttacggttcatatcgttggcggtcgccagcgcgtccagccccaccgaatgcagcatctggtgcaccggcttaacgttcttcttcagaataccgtggaactggaaggtctgacggttggtcagacggatactgccataaatcgtgttatccgccgcgaatttatcgatcgcctgccattgcgtcgtagtaatcaccccgcccggcaggcggcagcgcagcagcatggcgtggcgcggctccagcttctgcgccgcacgctcggcgcgaatatcgcggtcatcctgctgatacatgccatgaaagcgtattagcaggaagttgtcgcctttaaaaccgccggtgagaccgtcgttcagatcttccgcaatggtaccgcgcaggtagttgctttccagcttcatgcgctcggcatcggacagtttaccttcgaccaccagtgggcctggatatttttcgctcattagtagacatctcgctgataacggcgctctacgcgcagctcacttaaatattcatctgccgattcgaggtccataccgccgaattcagcgatcacttccagcaatgctttttcgacatctgcggccatgcgcctggcgtcgccgcagacataaatgtgggcgccatcattgatccagcgccacagctccgcgccctgttcacgcagcttgtcttgtacgtaaattttttctttttgatcgcgggaccaggcgagatcgatacggcttaacagtccctctttcacgtagcgctgccactccacctgatagaggaaatcttcggtaaagtgcgggttgccgaagaacagccagttcttgccttccgcgccatcggcggcacgctgttgcataaaggcgcggaacggcgcgatgccggtgccggggccaatcatgatcaccggcgtttgcgggttcgctggcaggcggaagttatcgttatgctcaataaagacgcgaacttcgccctcttcttccacgcggtcggcgaggaagctggaagcgccacccgcgcgggcgcggccttcgatatcatagcgaaccacgccaacggtgatatgcacttcactctccacttcagcctgtgcggaggcgatggagtacagacgcggcgtcagcgggcgcagcaggtcgattagcgcctgagcatccagctgcgccggagagaaacgcaccatatcaacgatcggcgtggtcgcggcgtaatgctggagctgcgctttgtcacccactaatggcaacagcgactcactgcgcgtcagggtcgcgtagttctcaacaatgttggcggtattcaccgtcagctcgaagtgccactccagcgcttcggcgagcggcagggttttaccatcaaccatcaccggctcatcgcctttcagccacagcaactcaaccagttccttcaccagagccggatcgttctgataccagacgcccagcgcatcgcccggctggtaacgcagaccggagtcgcctaaatcaatctcaatatgacgaacgtctttttccgagttgcgaccggtgattttctgattcacggagagggtcgcggtcagcggcgcgtctttggtataggggctggtgtggatgtcgtttaccgcgccagtagcgacggattgcgaaggtaccgcgacaggtgcacgggacttcagaacatcaaccacgcaggcgcgccattcgctggcagctgcctgatattcaacgtcagcatcgacacggtcgagcagacgctcaccgcccagttccgccagtttgctgtcgaaatcttttccggactggcagaaaaattcataagaggtgtcgccgaggctaaacacggcaaaagcggtgttttctagtttcggcgcttttttcgagaacaggaacttatgcagcgcgacagcctcttccggcggctcgccttctccctgggtggacgtcactatcaccaacagtttttcactggcaatctgtttgaatttgtagtcgccggcgttcaccagagtcacattaaggttggccgccagcagatcatcacgcagcgcttccgccacacgacgcgcattgccggtttgcgaagcggagataagcgtaactcccggcatcttcccatcaggagcaggcgtgacggcaacagcgcctgagcgcgggttcagtacgccccaaaaaaagccggagacccaggcaagctgttcgggagtaaggtcggttgtcgcggcctgaaggcgcgccagttgctccggattaagcggaagcaacccagtcagtggagccggtgtcgtcatgcgtcgttatgttccagtaagcaaagcggatctatacacaaaatcattcaagttcgctgtagcccagactgtaagctgatcgcgccccaggagcgtacataaatacgtgactggggcgagtaaacgcagtcaacacaaatgcggcttgaaggatgaagtgtataagcgataaatcccaaactaaggataagggtaacggtgagaggaataacaattaaagaagggttggaaataacaaataaccaaatgaactaacctgttttagttatcgttattaacgccaaaatcgatttcataattgattgataattattaaattttctggaaattcttaaattaattgcccgttacaaggcggagaatggttttagttaatgataaaaaatgcgctttccggtaccctacagcggtttttttattgcctgagagttcatcatgtccaccacgttgtataaagatttcacctttgaagccgctcaccgcctgcctcacgtgcctgaagggcataagtgcggccgcctgcacggacactcatttatggtgcgtctcgagattaccggtgaagtcgatccgcataccggttggattatggatttcgcggatctcaaagcggcgtttaaacctacttacgatcgtcttgatcactactatctgaatgatattccaggactgtccaatcccaccagcgaagtgctggcaaaatggatttgggatcaggttaagcccgtcgtgccgctactgagcgccgtgatggtgaaagagacctgtacagccggctgcgtctatcgcggcgaataaggtttattaacgcgtgggctggatggtaaattgattccagcctatccacacgacgttttatcagtgaaaacattgcccagcgcgcggtgttaaaagcgcagcacatcaccggttgcaggtgcggttatttccggtagccacaaccgcccccaggccccggtacagtgacaaccgcatagtttttcaggtttttgttcttgcagaaagcgcctgactcgccacagcgtgaacggtgatgcgcagcggagatgaaatccgccgataagcgcgtaaatccgctttataccggtaatgttctgacagtgccggacaatatttgcgatcccccgatgcccgcatcccataatgatgactaatccttttgtcgattggtaaatcagtacgccctcatccaaaatagagtccggctccgcatcgtggccgccaaaaatgccgtaggcttcaggcgcgaccaccggtatttcccctgaccagataaagttttcgccaatcggcagggggccacacgtgtacatcattcggtagcgtgaatagtccacctcacacgacaatttttttattttccgggtaataccgagaaaagttattgccgcataacgttcgcgcgcaatattgggatggcagatgattcgactgttatcaggaagccacggcacgccgccgcaatgatcgtaatgaccatgcgaaagcaccacagcagacacatcggacaggtcgatccccatcgccgacgcgttttgcataaaactgccatcagggccggtatcgaacaagatcgacgtagactcatcctcgaccaacaggcttaatcctggccgggccttcaacgatttatccgttccagctcccttatgattttcgagcaataccctgatccttaacgccatggccttctcctgtataaaagcctccccgggaaaacgcggcctttttactttacaggtttgtagcagccattactggtacacagattatgattatgcaacggctatccttgttgacgtggggaatactgctacacgcaaaaattccagtcgttggcgcacggtttatccccgctggcgcggggaacacactaaacgtatatcattgtttataaactactttttattagcaccacattctaccaacataatagcaacaatttaaattattaaagaacagctaatttgctgattttgatgcaaaaaagttcatagaatgattttttctttaaatttaccaaaataacgtgatccgtgcatcgctatggaaaaatttatcagcgcttttatacactcatcgaaattcacatagagaaaataaacaatgcaaggtaatggatgagtcacagacggcaacggcaggccgtccgtaagattaataatgcctcaggcgatatttaaatatttatgcgtttgcatagacagccgccagttacgcgcaatacacgtttcaatacacagacgcgtcgcgtcttctttctggctaatgggctgcaaagcaatcacgcgcggtttatcatcgctcaacgtggctaacagttcatccagcgcctcaatatcacgaactcgcccaacgggatgcttgatttcattggcgcgctccagcgcctgggaaagcacgtcatatcccccgcgcatattcacttttggtgaaaccgtgacccaggtattgggcgtacagcgcacttcgtgcgtcccgctggtttcaatctggcaactaaaaccactcttttcaagcagatcggtgagcggcatgaggtcgtgaatacagggttcgccaccggtgatgacaacgtgacgcgcggtatagccctgacgattaattactgccagcaagtcttcactgctcgcagcaccccatttgtcgctctctttggtttttgccagaatgctgaacagagacacttcccgatcgctcagtttatcccaggtatgcttagtatcacaccaggcacagccgaccggacatccctgtaaacgaataaaaatagcggggacgccggtaaaataaccctcgccttgtagggtctggaacatctcgttaatcgggtactgcatagcgttctctgttaaggggataatcgttaattattgcagatttcgtctgcccggtcatgcacagcggctgcgctattgaacagatacaaaaaaacccgccgaagcgggtttatacgttaagaggtaaaagcaggattacgcctggcctttgatctctttacgaccgttgtacggtgctttttcgcccagagcttcttcgatacgaatcagctggttgtatttagcaacacggtcagaacggctcatagaaccggttttgatctggcctgcagcggtaccaacagccaggtcagcaatggtagcgtcttcagtttcaccagaacggtgagagatgacagcagtgtagccagcgtctttcgccatcttgattgcagccagagtttcggtcagagaaccgatctggttgaatttgatcaggatggagttagcgatgcctttctcgatgccttctttcaggattttggtgttggttacgaacaggtcgtcaccaaccagctggattttgtcgcccagtactttggtctggtatgcaaaaccgtcccagtcagactcgtccagaccatcttcgatggaaacgatcgggtactgtttggtcagttcttccaggaagtgggtgaattcttcggaggtgaatgctttgttgccttcgccagccagaacgtatttaccgtctttgtagaattcagatgctgcgcagtccatcgccagggtgatgtctttacccagctcgtaaccagccgctttaaccgcttcagcgataacagccagcgcttcagcgttggaacccaggttcggcgcatagccgccttcgtcacccacagcggtgttcatgcctttgcctttcagcacttttgccaggtgatggaaaacttcagaacccatacggatggcttctttaaccgttttcgcgccaaccggctggatcatgaattcctggatgtcgacgttgttgtcagcgtgctcgccgccgttgatgatgttcatcatcggaaccggcatggagtatttgcccggcgtgccgttcagttcagcaatgtgctcgtacagcggcatacctttagcggcagcagcagctttggcgttagccagagagacagccagaatggcgtttgcaccgaagttagatttgttttcagtaccgtccaggtcgatcatgattttgtcgatgccagcctggtctttagcgtctttgccaagaatagcctgagcgatcgggccgttaaccgcgccaacagctttggttacgcctttacccaggaaacgggatttgtcgccatcgcgcagttccagcgcttcgcgggaaccagtagaagcacctgacggagccgccgccatacctacgaaaccaccttccaggtgtacttcagcttcaacagtcgggttaccacgggagtcgatgatttcacgaccgatgactttaacgattttggacattaggttttcctcaagtcactagttaaactaaaacttcagacaaacggtgcaccgctgagggtgcaccgccgttctaacttttttacttcgcctgacgtttctgatgctcgttggcggctttaacaaagccggcgaacaacggatgtccatcacgcggcgtggaagtaaattccggatggaactgacaggccacgaaccacggatgattcggtacctcaatgatctcgactaactgatcatcaccggaacggcctgcgacacgcagacccgctgcttcaatttgtttcaacaacatattgttgacttcgtaacgatggcgatgacgttcaacaatcgtcgacgcgccgtacaactgacgtaccaggctgtcatcgctaagctggcactgctgcgcgcccaggcgcatggtgccgcccagatcgcttttctcgctacggacttcaacgttaccgtcttcatcgcgccactcggtaattaacgccacaaccgggtacttacagtctggcacaaattccgttgagttggcgttgtccatgccggccacgttacgagcgaactcaatcaacgcaacctgcatccccaggcaaatgcccagataaggaatattgttttcacgcgcatagcgcgcagtggcgattttaccttcaacgccacgatagccgaagccgccggggatcaggatagcgtccaaatctttcagaatttcgacgccgcgcgtttcaacatcttgcgaatcgatcaatttgatgttgacggtaacgcggtttttcagaccaccgtgtttcagcgcttcgatcaccgacttataggcatccggcagttcaatatatttgccgaccatgccgatagtcacttcgcctgccgggttcgcttcttcgtaaatgacctgttcccattcagacaggttagcttccggacagttcaagctgaatcgtttacaaatataatcatcaagcccctgagatttcaacaggcctggaattttataaatggaatcgacatctttcattgaaataacggctttttccggcacattacagaacaatgcaatttttgcacgctcgttggcaggaaccgcacggtcggaacgacaaatcagaatatcgggctgaataccgatagacagcagctctttcacggagtgctgagtcggtttagttttcacttcgcccgcagccgccaggtaaggtaccagcgtcaggtgcataaacagcgcgtgttcacgaccgatatctaccgccaattgacgaatcgcctcaagaaacggcagcgattcgatatcaccgacggtaccgccgatttccaccagcaccacatcgtggccttcgccaccttccagcacgcgctctttaatcgcgttagtgatgtgagggatgacctgtacggttgcgcccagatagtcgccacggcgttctttacgcagaacgtcggagtagatacggccagtcgtgaagttgttgcggcgagacatcttggtgcggatgaaacgctcgtagtgccccaggtccaggtcggtttcagcgccgtcttcagtaacgaacacttccccgtgttggattgggctcatagtacccggatcgacgttgatgtacggatccagtttcatgatggtcacgttgagaccacgggcttccagaatggctgcgagggaggctgcggcaatgcctttacccagagaggatacgaccccgccggtcacaaaaatatagttcgttgtcatgcggaacctgagaagttaggtttaaaagacgatggaataaccaggacgggaaagcagtatacccgaacatgacctacgccacaaactttcattattcctcctcttcgccaggctgacattcacacagggagggagaaaatagcccctttgaggtaaatgtttttgacgtaaatcaagcgcttgttatttaaaaaatcacacaaatcgctcttgaccgcctaaaacctttagagatcaatttcctggcgttttacttcctgccaaacttcttccattgtttccaggtctaccccggtcatttccaggcctctggctgcgacaatacgttcaacttcgcgaaaacgacgttcaaatttatcgttcgctttttgcaaagcgatctccgctttcgtacctaaatgacgcgccatgttgaccgtggcaaagagcaaatcgcccatttcctcttccagtttagcctgatcaacaaccgcctgccgcgcctcgaacatcacctcatcgatctcttcatagaccttatcgacgaccggccccagcgtcgtccagtcgaagcccacgtttgaacaccgtttctggattttttgcgcgcgcattaaggccggtaagctgcgcggaatatcgtccagcgcggaatgctgcgctttttgcgcgcgctcttccgttttgatttgctcccagcgaactaatgcttcttcgctattatccgcggaaagctcgccaaaaacatgcggatggcggcgctccagcttgtcgctgatggcagcgcaaatatcattaaaatcgaagcggccttcttcctgcgccatctgcgcgtaaaacaccacctggaacaacaggtcgcccagttcgccgcgcaaatcgtcaaaatcctcacgcgcaatcgcatccagtacttcataggtttcttccagtgtataaggcgcgatgctggcgaaggtctgctctttatcccacgggcagccgttttccgggtcgcgcaggcgctgcatgagggtgagaagacggtcaatttgatggttagttgtcatggtctttaatcggttgtaaatactagcgacaattgtaacgtattattcttaaccattcacgcacagagacactacgacaacgcctatataataaaatatattgttaacaggtgttgaatgctacctttcccgtataactttaaaattattaatcgatacacaacaatataataatcatataactaatttattaaaaaaaaacagatatttgcactaggcattataaataacatcaattaagtaaaaaaattatgcaaacactataagccccccacccaaaagagccttccctttcaaaaaaaaataaattatttcacttttacggaaaaacgagtagcatgcacgccagtttaatattcaaaaaagaccgcttttttgttttttctgaaacatacatgaaataaatatattgaaagtattacatataatattctatgaacctgtacgaccattctgttcataagaatatactcataaaaatgtagaaatataatattttattattacatattttttacccaaagcccgcagcatggctctatgccgcatatcccttgatatacgcgtacaaaatgctgccataaaacacgttaattaaggataacacgatgaagtcatctcatttttgtaaactggcagtaactgcatctttagttatgggaattgtctccggcgctcaagccgcgggtagcaacacagcaaaggttactttccttggtaatattgttgattccccctgctctgtcacattggatacggaagatcaaacagtcaatatgggctcaagtatcggtaatggcacgctgagtaatggtaaaacgaccatcaacaatgcccgtacctttcatatcgatcttgagggttgtacctaggctaccgagaaaaatatgaatgtggtattcactacaggtagtggaaccacagcggctacaggcgccacggataatctcgcgctgatgaagactgacggcactggcgctattagcaacataagcctggcaatcggcgatgcaggcaaaaacaatatcaaactgggcgatacctatacacaggccattgcggacctggacagagataccatccttgatgagaagcaaagcctgaatttcaccgcctggctggttggcgcagcaaccggcaccgtaggcacaggtgaattcagcagcgccgccaacgtcactatctcttacctgtaattcagataacagagtcacgacgataaataccctgccgctttaggtagggtattcctgttgagttttattgcggaatatatttgatgaataacacatggaaaagtgttctttgcccaatagcgtgtggagtgggaatgcttctaagcgcctccccttatagcgcgtcaggcaaagacatcgaatttaataccgatttcctcgatgtaaaaaatcgcgataacgtcaacattgcacagttttctcgtaagggttttatcctgccaggcgtctaccttttacaaattaaaattaacggacagactctgccgcaggaatttcctgttaactgggttattccagaacatgatccacaaggaagtgaggtttgcgcagaaccagaattagttacgcaattgggtataaagccggaactcgcggaaaaactcgtctggataacgcacggtgaacgacaatgtctggcgccagattcactgaaaggcatggattttcaggctgacctgggacactccacgctgctggtgaatttaccccaggcgtatatggaatacagcgatgtcgactgggacccacccgcccgctgggataatggtattcccggcatcattctggattacaacattaataatcagctccgccacgatcaagaaagcggcagcgaagagcaaagcatcagcggcaacgggacgttaggcgcgaacctgggcgcatggcgactacgggccgactggcaggccagctacgaccatcgtgacgatgacgagagcacttccaccctccacgatcagagctggagccgctactacgcctatcgcgcactaccgacgctcggggccaaacttacgctgggcgaaagctatctccagtccgatgttttcgacagctttaactatatcggtgccagcgtcgtttctgacgatcagatgctgccgccgaaactgcgcggctatgcgccggagatcgtgggcattgcgcgctctaatgcaaaagtcaaagtctcctggcaggggcgcgtactgtatgaaacgcaggtgcccgcaggaccgttccgtattcaggatctcaaccagtccgtttccggtacgttgcacgtcaccgtggaagagcagaacggtcagacccaggagtttgacgttaacaccgcatcggttcccttcctgacgcgccccggcatggtgcgctacaagatggcgctgggccgcccgcaggactgggatcatcaccctattaccggcacattcgcctcggcggaggcttcgtggggggtcaccaacggctggtcgctctatggcggcgcaattggagaaagcaactatcaggccgtggcgctgggaagcggtaaggatcttggcgtggtgggcgcggtggcggtggacattacgcactccatcgcccacatgccgcaagacgacgggtttgacggcgaaacgctgcagggtaactcatatcgcatcagctactcccgtgactttgatgaaatcgacagccgactaacctttgccggataccgcttctcagaaaagaactttatgagcatgagcgactatctggatgcgaaaacctatcatcatctcaatgccggtcacgaaaaagaacgctatacggtcacctataaccagaacttccgtgaacagggcatgagcgcctatttcagctactcacgcagtaccttctgggacagcccggatcagagtaactataacctgtctctttcctggtacttcgacttagggtcgataaaaaatctcagtgcgtcgctgaacggctatcgcagcgaatataacggtgataaagatgatggcgtctatatctcgctgtctgttccctggggcaatgattccatcagctacaacggtacgtttaacggtagtcaacaccgtaatcagctcggctattccggccacagccagaacggcgataactggcagcttcacgtcgggcaggatgaacaaagcgcgcaggcagacggttattacagccatcagggcgcgctgacggacatcgatctgagcgcggattatgaagaaggatcgtaccgttcgctgagtatgtcgctgcgcggcggcatgacgctgaccacccagggcggcgcgctacaccggggaagtttagcgggcagcacacgtttgctggttgataccgacggcattgcggacgtccccgttagcggtaacggctcgccaacctcaaccaacattttcggcaaggccgtgattgcggatgtcggaagctattcgcgcagcctggcgcgtatcgatctgaacaaattgccggagaaggcggaagctactaagtcggttgtgcagatcacgctcaccgaaggcgccatcggctaccgtcactttgacgtggtcagcggcgagaaaatgatggcggttttccggctagcagacggcgacttcccacctttcggcgccgaagtgaaaaacgagcgccagcagcagttgggcctggtggccgatgacggcaacgcctggctggcgggcgtaaaagccggggaaacattgaaagtcttctgggatggcacggcgcagtgtgaagcatcactcccgcccacgtttacaccagagctattggccaacgcgctattgctgccgtgcaaaatgctggaaggtcagccccccaccgcaccgcagaaaagttctccgctgcctgcgcaaccgctaatccaggaacatacgcaaaccgatggccaaccggccgcgccggtggcgacaaccactcaaaccccgcccataccgctggctgacaaccatgcggtgaatcgcaaggatatggaataaagggaacctgtaatgaacaagaccaaccattttaatcgccaggcgcttattgccacggtattactggctgcgccgctggtgtcacacagcgcgattgtgccggatcgtacccgcgttatttttaacggcaatgaaaattcaatcaccgtcacgctgaaaaacggcaacgccactctgccctatctcgctcaggcgtggctggaagacgataagttcgccaaagatacccgctattttaccgccctgccgccgctgcagcgtattgagccaaaatccgacgggcaggttaaagtccagccgttaccagccgcggctggcctaccgcaggaccgggaaagtctgttttatttcaacgtgcgagaaattccgccgaaaagcgataagcctaatacgctccagctggcgctgcaaacgcgtattaagtttttctaccgcccggtagccgtagcccggcaggtggataagacgcacccgtggcagacgaagctcacgctgacctaccagggcgatggtgtgatcttcgacaaccccacaccgttttacctcgtcatcagcaatgccggtagcaaagagaacgagaccgcctccggctttaaaaacctgctgattgccccgcgtgaaaaagtgacctctcccatcaaaggtgcctcgctcggcagctcaccggtggtgggctacgtcgatgattacggcggccatcgcctgctggtttttacctgctcagggaatacctgcaaggtcaatgaggaaaaaacccgtgacgctgagaagaaagcgaataagtaatcctgtgcgaaagagatctatgacgatgttgactcgctggaaaatactggtgctgctgtgcggtggattcgttaccggcaccgaggctgccggcacaaaaaccgtgcaactggagctgcatctggtcgtcactcaaccaccgccctgtacggtaggcggcgcttccgtagagtttggcgatgtcctgaccaccaaagttggcgatgtttctcaaacgaaacctgtgggctacagcctgaactgcgatggcagagcgagtgactatctgaagctacaaattcaggggaccaccaccaccatcagcggggagcaggttctgcaaacttcggtgcaggggttaggcatccgtattcagcaggcgggcaataagcaactggttccggttggcataacggattggctgaacttcaccctgagcggcagcaatgggccggagctggaagccgtaccggttaaagagcccaccacgcagttagcgggtggcgattttaacgccagtgcgacgttagtcgtggattaccagtgatggagagattcatagtgaaaagggtgcttatcctgacgcttttaatcacccggtttgcctgcgccgacaatttgacctttcacggcaaactgataaacccgcccgcctgtactatcaataatggtgaaacgctggaggtcagttttggtagcgtgattattgataatattgacggcgtcaattacctgaccgagatcccgtggacccttacctgcgacagcagctttcgcgatgacgcattaacttttacgttgagctatctgggcacggcgacgccttactccgcaaaagccttaaccaccaatgtccctgggctgggcattgaacttcagcagaacggcacggtgtttcctcccggcacgtcgctaaccatcaatgagtcatcgcttcccacactaaaagccgtgccggtaaaacagcccggtaaagagcctgccgaaggcgattttgaagcttttgccacgttacaggtggattaccaatgaaccgtatttttcaaactaccgggcatttgatcggaggcgtaatgttatgggcggtttgcaatacgctacctgctgccacgcctaatgtgcactacagcggtaagctggttgccggagcctgtaacctggtagtggataatgacacgatggcgacggtggattttcatactattggcagtgacaatttcgacgccagcgggcaaacgactcctgttccattcacacttagcctccaggattgcaaaacagcgctagccaacggcgtggtggtgacctttcagggtgttgaagacagtaccctgcccggactgctggcgctcgaatcgtcttctattgctaacggttttgctatagggattgagaccgcagatcagcacccgttaattatcaacgcttctcaaggtacggaatttatgttggcagagggaaataccattatcaatctccaggcatggctacaaaaaacatcaggggaaaatattatgcctggggaatttaacgccagcgcaatggttaattttgaataccaataatgttatttaacaaaaaggcattgatgctctggccagaataaaaaggagttacaacgcaatggaaataaaaaaaagcatcttggttagaaaaaatatacgcttgtcaggaatcatcattgacatgctcattttaaccatacttttaatcagcacgtttgatgctgtatctgactcttccccggtaaaagcaagcgctatcaatattgcacttcaaggaactcccaacacagattatgaattaaatggcgatctccgctctaacggagggataatgccaaagacgctttatatggtatgttcaggaggaaaattcagtgcaagccaggctgattgcgttgccggtcaatgggtagatatcgaagttgtaatatctgcggacagtcatacgttcatgaatttgacaaatatgggcaatttgagttcttctgcatttcaggaaaaaaggcgtgctcgctgtacagcgaaaaatagtaatacgatggattgtatttgggaaagtaacttcgacattaacttgtttttttcaccttctacaaacatctcctcaattgaaagacaatctctgactctccatatcgagcctacgaataatgcatcaccttctctacagcaaatcaatatcagcggcgacttaatctaccagccttctgactacgcagtgtataatcaaggatatactcctgacgtcttagcctacgttaatttttatgctaaatacaatatcgtccaatcaagctttggtacacagacaggcccggcgacgggcgccctgccgggacgcctcaatctgaacgggaacgtagcgaccacagtttctttatatcctgaacaacttgatgcctctttttcgaaaacagaattttccatcacatctgccagcaaagaatttacgggttctggtaataatgaactactggcagaaatctatctaaactatggactacagcattgccagccgcaaacggcagatagtatttgtggtcaaatattagctaacgcgaacgtttcaacatcgtgtggtgatcataatattactatcacaaccaatatgtgcaatacaggtaatgaccaatgtgatagtgatgaaacatggaaaattgcagagatcttcgggacatggggccgggttaatgtcgacactatatgcgctattacagtattgcttccctatgaataatgcttagaaaaaatactcggaaccctaaataatctcgcaaaacagtagattacttatccgaaaaatttttcggccttcagtgaggggctctgctccagttgcgcgatcagatcatttaaccaaaataatagtcgaacaaaagaggcgagccatgaacggctaccatttctttcgcgagttaagcgaagaatgctgaaaaaacagtacagaaaagtcaggataaagagttatacagacggcttaccactatcccaatgctgtatacaggattattggttagttcactttactgctcctaaaaaacctgcctcacttaaaatttagcaaaattattgaccaaggaaaacaaatgtgtacaaattttttaaaaacatcgctactaataacatccactttttggtgtattgcgctacaatgcgctgaagtaagaacggatataaaatataattctcaaattatttcacagtttgatagtattagcgcactggctggcgatcctacattcgataccatccataccccattaccaacaaacattcatatcctttcatcgtgcactaagtcaggtggagggggggttgtattccaggtacattgcctgatggacttgaatccactcttgagtttgatccatcaacttctttcatcaatacaaccgctgtcgataacggtatcacttatagttttactggtgaagcggtaaaagcgacggcacatgccagctgtacggctaatcaggcaactaacagcgcaatttgtgtatgggataaatcattttcacttcccctcaccttacttaccaaacagaacggaataaccattaaccagcaaaatcttacagtttcggtaatacccggaggaggaaataatgatactaaccagtactcatccctttccggccatattattattgatgaatcggtaagcagctacacgaattatgaaccggaaacatcgggcattgagaatttaaaattaaaatggactgtaacagtgacagaagataccgaaggtgatgtcggtatatggaacggatcacttgtacttaatggctctccagcgtccaccctacatcgttatttgcttccagaaatattagatgcttcattttctgaaaatgcgatagcgcacagtaccgaagtcgccatgactggcgcaaaaaataatgtcgagctagcctctgtatatctctaccatggcaatacgccatgcgatgatacatccttgtgtaactacagtcttaataagacatcagtttctcttgtatgtcacgatctgaatgcgcaacttaactttagcaacacttgtaatgcttcaggcacaacacattgcctgaacggaaaagtaggtacgataaagggtacctgggagagagtcaacatcgatacaacttgtgcaattaccgttttgataccctacgaataaacacaggaaaaatgatgaccataagcaaaagaatcataatttcatttattctatttatgtgcttcaccaacaatacatttggatctggatacgttaagatcaatgccgaattgaatgatatggcaggcagaggggtaggcacagtgatttaaatagtaatctacggcgaaggggaaatctttctttttggttgtacagggaacgcttcggcataccagaaaggaggtcagcccctcacgggatagatgaaaaaacagatccagaatcgcagggcgaaaagagttaatgatgagaacagataaagaatgaagaagcttagatccagactcatagctaattattcatagaataaatactatagtaatgaataaaattcagaataggtgttacgtatttcaaacacataaaaccttaaccgatatcacatagagtataacttaaaaaggctataaccaatttacatgcttaccagcatcctgattctggctcagaatacgtatcacgataacttccgtaactgattatataaaatagataatatgcctttcaaacggtaaggcataaatgtattcacccagttcaggtcgaggcgtgccaatgttattggcactcataatgctgaatatttctgatagatgatgaatatatcgatcggcctgtatttcaccaaaatgctgccagccgtaatgccagatattttccagatcttcactggcctttggcgttaattttaccgttctcatcgggtttgatcatccctgttttgaccttccgtaaaaaggcatccttttcccaggcctgcggctctccgctgttcagaccttcagccagaagttcacgtaacgcctgaagtcgtgactcggcctgtttttccctcagcagacgaagagactctctgatcacttcactttgcgttctgtaatcacctgattctatgagcgattcaataaactcgcgcaattcatcgccaagatcaacggtcattgttctggccataacagcctccactgtaagtataaatcttacataagagtacacctgaaatgaaatgtacgtcaaaaacatacctcatatatcatgcttatggggttggctaatgcggctttgctgaacgagtagcaaagccgctacattattactgtctggggtttaccccccgtgcagtcgccgtgcatcaatcacatccggcacctggttcagcttaccgagcacgcggcccagcacctgcaggttgtagatctcgatggtcatatcaatggtggcgatctgctgtttaatgtcgctgcggctggcgacgcccagcacgttgactttttcgttagccagaatggtggtgatatcacgcaataaaccgctgcgatcgttggcctggacgcgcaccaccagcgaatatcccgccgagtagctttcgccccataccgcctctacgatccgctccggcgcatgggagcgcagttccgccagctgttcgcagtcggcccggtgcacggaaatcccccgcccctgagtaatgaagccgacaatttcatcccccggaatcggctggcagcagcgggcaatgtggtgcatcaggttaccaaccccttccaccaccacgcgcccgtcgtctttacgacgattttgcggcgcgtatgttttttgctgaagctgtttcagcgccgctgcatcctgctcctctgcactcggcttattgaactgcgattgcaggaaattcaccatctgattaagacggatatcgccgccgcctatcgccgccagcaactcttccagctcattaaagttgtagcgcggcagcagatgtttttcggcctctttcaggctaatccccaaatgcgccagctcatcgtcgaggatctgccgtccagccaggatatttttgtcacggtcctgtttacggaaccaggcgtgaattttcgagcgtccgcggctggtcgtcacatagcccaggtttggattcagccagtcgcggctgggattcggctgcttctgagtgataatttcaacctgatcgcccatctgtaactggtaggtaaacggtacgatgcgcccaccaattttcgcgccgatgcagcggtgcccgacatcgctgtggatgtggtaagcaaaatcgagcggcgtagatccggcaggcaagtcaaccacgtcgccttttggcgtaaaaacgtagacccgatcgtcaaacacctggctgcgcacttcatccagcatttcgccggaatcggccatctcttcctgccaggcgatcagcttacgcagccacgcaattctgtcttcatggccggaacgcacgccgccggacgcggcgccttctttatacttccagtgcgccgccacacccagttcggcgtcttcatgcatctgtttggtacggatctggatctcaacggttttaccgcccggccccaagaccacggtgtggatagactggtaaccgttcggtttcgggttagcgacataatcatcgaattcatccggcaggtggcgatagtgcgtatgcactatccccaacgcggcgtagcagtcttgcagacgttcagcgacgatacgcacggcgcgcacgtcaaagagttcatcaaacgccagatgctttttctgcattttgcgccagatgctataaatatgttttggtcgtccgtagacttccgcctgcacgccttcgtttttcatttcggcgcgcagatgtccaacaaactcttcgatgtaatgttcgcgatcgaggcggcgttcatgcagcagtttggcgatgcgtttgtattccgccggatgcaggtagcggaaacagtagtcttccagttcccacttcagttgcccgatgcccagacgattagcgagcggcgcatagatgttggtacattctttcgccgccagcacgcgctcatcttccggcgcctctttcacttcgcgcaaatgagcgattcgctcggccagtttgatgaccacgcagcggaaatcatccaccatcgccaataacattcgacggacgttatcaacctgctccgaagaaacagagtcgttatgagtggcgtttaactggcggatcgccgccatatcgcgcacgccatgaatcagggtaacgatagatttgccaacgctttcgcgcagtacatcttcgctgactacgttggcgtcggccagagggaacagtagcgccgcccgcagcgtgtcgatatccatactcagcgtggaaagaatttctaccatctccacgccacgccacagcaacagatccgcatccggatgtccttgtgtctgttgcaggcaatacgcccaggtttcggctaagcgctcacacgactgctggctggaaattcccaggcttgcgatccacttcttcggatcaaattcaccagctttattaatatgtgcacttcttaccgcgaccatcgtcctctccttaagggaccaggcctaccgaagtcggtaagccggtaatcattacatgcgctcgaacagaaccattgattccagatgtcctgtgtgcgggaacatgtcgagcatcgctaaacgcgtaacctcatatcccgcattgaccagcgcttcactatcgcgcgccagcgtcgccgggttacaggatacataaacaatgcgaataggttttaattttataatatgtcgcatcactcctgtagcccccgcacgcgcaggatcgagtaagactttgtcaaagccgtttttcgcccacggctgcttcgtgacatcttcctccaggttctcgtggaagaatgtcacattatgtaaaccattgcggatggcgttttcacggcctttttctaccagcgcctgaacgccctcaacccctaccacgcttgccgcgcgcgttgccagcggtagcgtaaaattccccattccgcagaacagatccaggacacgatcctcggcgcgcacatcaagccactccagcgcgcgggcgaccatttgctggtttaccgcctcattaacctgaataaagtctcgcggactgaaggttaaacgtaagccgtgcgaatcataccagggcgcttcgccagataccgtttccagtatctcgctaaacggcgccaggaacagagacaatccctcagaatgcgaaaagcgttccagtttttctttatccgccgcacttaatggcgcggtatggcgcagaatcatcagcgtaccgcttcccgcctgtaccagctcaacatgcccaagatgtcgggtgccgtgtaaactcgccagacacgccctgatgcggggcagcaatgcttcaagctggggcgccaaaacggggcactgttcgacattgacgatatcgctggaacccgctttgcgaaatcccatttgcagcggtttatccggcgggcaattcagacttaaccgcgcacgacgccgataaccccaggacgcgccggcgatgatgtcattcacctcatgtttcattaaacgcgccagcgccgcgcttttgctgcgttgttgcaggtcgatgccgacatgctgttgctgacaaccgccgcagacgccaaaatgcgggcagcgcggcgtttctcgttccgggctatcattcaaacggcgcgaaacgcgtgcgcgggcaaattgctttttatcttctgtaataatgacttctgcgctttcctcaggcaataaaccggggataaacagcgcctttccgttatgacgggctacgccctgaccaaatgaatcgaggtcattgactttaacggttatgatctgacgcgtcgtcacgcgccgttttgcagagtagaattgcgccatcgaccagctttttctcaatttaacagtgtgaccctaattgtcccataacggaactccatgaccaactacagcctgcgcgcacgcatgatgattctgatcctggccccgaccgtcctgataggtttgctgctcagtatcttttttgtagtgcaccgctataacgacctgcagcgtcaactggaagatgccggcgccagtattattgaaccgctcgccgtctccagcgaatatggtatgaacttacaaaaccgggagtctatcggccaacttatcagcgtcctgcaccgcagacactctgatattgtgcgggcgatttccgtttatgacgatcataaccgcctgtttgtaacgtctaatttccatctggacccctcacagatgcagcttcctgccggagcgccgtttccacgtcgtctgagcgttgatcgccacggcgatattatgattctgcgcaccccgattatctcggagagctattcgccggacgagtcagcgattgccgacgcgaaaaataccaaaaatatgctggggtatgtggcacttgaactggatctcaagtcggtcaggctacagcaatacaaagagatttttatctccagcgtgatgatgcttttttgtattggcattgcgctgatctttggctggcggcttatgcgcgatgtcaccgggcctatccgtaatatggtgaataccgttgaccgcattcgccgcggacaactggatagccgtgtggaaggatttatgctgggcgagctggacatgctgaaaaacggcattaattccatggcgatgtcgcttgccgcctatcacgaagagatgcagcataatatcgatcaggccacctcggacctgcgtgaaacccttgagcagatggaaatccaaaacgttgagctggatctggcgaaaaagcgcgcccaggaagcggcgcgtattaagtcggagttcctggcgaacatgtcgcacgaactgcgaacaccgctgaacggcgtcattggttttacccgcctgacattaaaaacggagctgaaccccacccagcgcgaccatctgaacaccattgagcgttccgcgaataatctgctggcaatcattaatgacgtgctcgacttctccaagctggaagccggtaagctcattctggaaagtatcccttttccactgcgcaacacgctggatgaagtggttacgctgctggcccactcgtcgcatgataaagggctggagttgacgttaaatattaaaaacgacgtcccggaaaatgtgattggcgacccgctgcgcctgcaacaggtcattactaatctggtgggcaatgccattaagttcaccgagagtggcaatatcgacattctggtagaaaagcgggcgctcagtaacaccaaagtacagattgaagtgcagatccgcgatacggggatcggcattccggagcgcgaccagtcgcgactgtttcaggcgtttcgccaggccgatgccagtatttctcgccgtcacggcggcaccgggcttgggctggtgattacgcaaaagctggtcaacgaaatgggcggggatatctctttccacagccagcctaatcgcggctcgaccttctggtttcatattaatcttgatcttaacccaaatgtcattattgacgggccgtcgaccgcgtgtctggccgggaaacggctggcttatatcgaaccgaatgctaccgccgcgcaatgtaccctggatctactgagcgacacgccggtggaagtgatttacagcccgaccttctccgcgctgccgttagcgcactacgatattatgattttgagcgttccggtgaccttccgcgagccgctcaccatgcagcatgaacgtctggcgaaagcagcgtcaatgacggactttctactgctggcgctaccttgccatgcgcaaattaatgccgaaaagctgaaacaaggaggcgcggcagcctgtctgttaaaaccattgacgtcaacgcgcctgttgccagcgctgacagaatattgccagttgaatcaccatcctgaaccgctgctaatggataccagtaaaatcaccatgacggttatggcggttgatgataatcccgctaatctgaagcttatcggcgcgttactggaagataaagtccagcacgtagagctttgtgatagcggacatcaggcggtggatcgggcgaaacaaatgcagtttgatctgattttgatggatattcagatgccggatatggacggcatacgcgcctgcgagttaattcaccagcttcctcatcagcagcaaacaccggttattgccgttacggcacatgcgatggccgggcaaaaagagaagttgctcagcgcgggcatgaacgactatctggctaaaccgatagaagaagagaagttgcataatctgttgctgcgctataaacccggcgccaacgtagcagcgcgcctgatggcgccggaaccggctgagtttatcttcaatccgaatgcgacgctcgactggcagcttgcgctccgccaggctgccggtaagcccgatctggcacgggatatgctgcaaatgctgattgattttctgccggaagtgcgcaacaaaattgaagaacaactggtgggagagaatcccaacggcctggtcgatctggtccataagctacacgggagctgcggctatagcggcgtaccgcggatgaagaacctttgccagcttattgagcaacagcttcgcagcggcgtccacgaagaggagctggagcctgagtttctggagctgctggatgagatggataatgtcgcgcgtgaagcgaagaagatattaggctgatattcgccggatggcggcgtaaccgccttatccggcctacaactcagcgtaattgttgccccgctttcagcgttgcagccacgttgcgcgcggtcattcgtacgttttcactcgcattcttcagcgcgtcctccaacgtgcagatggtataaatcacgctgaaaacggcatcaagcccatgttcatgaaccacgccaacgtccgccgtcaggctacccgcaataccaattaccggcttgttataccgtttggcgatgtttgccacgccaatagggactttaccgtgaatggtctgactgtcgatgcgtccctcgccggtgatgactaaatcagcatccgcaagacacgcttccagatgaagcgcatcggtgacaatctcaataccacgccgtagctgcgcgccgcaaaacgcgtataacgccgcccccatgccgcctgccgcgccgccgcctgccagatccaacacatcgacatgcagatcgcgggcaatcaaatgcgcatagcgagtcaatgccgtatctaggcgttcaatcatttccggcgtcgcccctttttgcggaccaaaaactgcagacgcgccctctttgccggtaaggggattcgtgacatcgcaggcgacctctatatggcacgccgacaaacgcttatccaggccgctgatatcaatgctggcgagtgtttccagcccaatgccgccttgcgcaatatcattgccctgcgcatcccgtagcctggcacccagcgcctgtaccatccccgcgccgccatcgttggtggcgctaccgccgataccaataatgatatgctcaacgcccgcatccagcgcatgacggatcagctcgccggttccccatgacgtggtcttcaacggatcgcgttgcgcgggcggcacctgctccagcccgctggcggccgccatttcaatgaacgcggaacgcgcatcgccggaaagcccataaaacgcattgacgcgatgccccaacggcccggtgacctcaacatgcacgattcgacccgccgtcgcttcaaccatcgcttcgacagtaccttctccgccatcagccagcggtaatttcaggtaatccgcgtcaggccagatctcgcgaaatccttgttcaatggcggtcgctacctcaagagcactcaaactttccttatacgaatctggtgcgatcactattttcataagtcgtccttacgcatgttgatcctgttaagcatacacccagagaaggaccggttccttacggaaccggctctgacttaacgcaccatgcaagggcgcttattatcaaacgtccagccaggaattaagtactgcattcccatcgcgtcgtcacgcgcgcctaagccatgcttttgatagagctcatgcgctttcatcacctgatccatatcgagctcaacgcccagccccggtttggtcggtacttgcaccatgccgcctttaatttcaaacggttctttagtcagacgttggttgccttcctgccagatccagtgggtatcgatagcagtgatcttgcccggcgccgccgcggcaacatgggtaaacatcgccagtgaaatatcaaagtggttgttagagtgcgagccccaagtcaggccgaactcatgacacatttgcgccacgcgtacagagccttgcatagtccagaagtgcgggtccgccagcgggatatcgacggattgcagcgacagcgtatgccccatctgacgccagtcggtggcgatcatattggtggccgtcggtaatccggtcgcgcgacggaattccgccatcacttcacgaccggaaaaaccctgctccgcgccgcacggatcttctgcataggccagagaaccttttaggtatttaccaatgctgatcgcttcgttcagcgaccaggcaccgtttggatcgagcgtgacgcgcgcttgtgggaaacgtttcgccagcgccacgattgactcggcctcttcttcgcccgccagcacgccgcctttcagtttgaagtcgttgaagccgtatttttcatacgccgcttccgccagacgcactaccgtttccggcgtcatcgcctcttcatggcgcagacgataccagtcgcattgctcatccggctggctttgatacggcagcggcgtaaccttgcgattgccgacaaagaacagataacccagcatttcgacttcgctgcgctgctgaccgtcgcctaacagcgaagcgacgttgacgcccagatgttggcccaaaaggtcaagcattgccgcttcaatgcccgtcaccacatggatagtggtacggagatcgaacgtttgtaaaccgcgtccgcccgcatcgcgatcggcaaactggttgcgaacggcggtcaggacatttttatattcatccagcgtttttcccaccaccagtggaatcgcatcttccagcgttttgcgaattttttcgccgcccggaatctcgccgaccccagtatgaccggagttatctttaacaatgacgatgttgcgcgtaaagaacggggcgtgcgcgccgctcaggttcatcagcatactgtcatgacccgcaaccgggataacctgcatttcagtcactacaggcgtggtaaattgagtactcataactgtgtccttattcagaattagtgacgaccaaaaacagggcgtttgcggtcaaaagtccagccggggatcaggtattgcatcgggcctgcatcattacgcgcgccgcctggcagctttttatacgcgtcatgcgcttttcgcacctgttcccagtcaagctctacgcccagtcctggcgcatccggaacggcaattttgccgtttttaatttccagcggatttttagtcaggcggcaatcgccctcctgccagatccagtgcgtatcaatagcggtgggtttgcctggcgccgccgcgccgacatgggtaaacatcgccagtgaaatatcaaaatggttattcgaatggcagccccaggttagcccccagtcatcgcacagttgcgccacgcgaacggcgccggtaagggtccagaaatgcgggtcggcaagaggaatatctaccgcgttgagcatcaccgcgtgtcccatttcacgccagttggtggcaatcatattggtcgccaccggcagtcctgtcgcgcggcggaactccgccatgacttcacgaccagagaatccttgctccgcgccgcacggatcttccgcgtaggtcagtacatcattcagccctttgcacaacgcaatggcttcatccagtagccaggcgccgttcggatccacggtaatacgcgcgtccgggaagcgtttttttagcgcgcgaacggtatcaatctcttgttcgcccggcagcacgccgcccttgagtttaaaatctttaaagccgtagcgatcctgagacgcttccgccagccgcacgaccgcgtcgctgttcagcgcttcctgatggcgcagacgataccattcatgactgcccggcgtgctttccagatacggcagatcggttttagtgcgatcgccaatatagaagagatagcccaacacggtgacggcatcgcgctgtttacctggccctaacagttcacagaccggcacattaagcgcctgtccctgtagatcaagcagcgccgcttccaaagccgccaccgcgttaacccgcagttcaaacgtccatgcgcctttgccaaaggtgtcaaaatcagcggcctggttgcctttatgcacctgctgcaccactttgttcaggcgggcgacttcctggcctaataccatcggaatagcatcgaccagcgtctgataaatcacttctccgcccggcgtctcgccgacgccagtatgcccggcgttatcggtgaggacgacgatgttacgggtgaagtacgcgttatgcgcgccgccgatgttgagtagcatactgtcatgtccggcaaccggaatgaccttcatgtccgtaataacgggactggattgcgttgtcatgataattgtcctgcgacaggtttcagttcaatacgcttaatatcgcctaccagcaccagatagctgatgatggccaccagggcatgtacgccgacatagatcaacgcgccgttgaaggaaccggtggtgccaacgatgtaaccaatcgcgattggcgtcacaataccggaaatattgccgaacatattaaacaagccgccggaaagaccgctgatctctttcggggcggtatccgccattactgcccagcccaacgcgccaatacctttaccgaagaaggccaacaccataaagccgatgatcatccattccacgttcacatagttacagaacaccataaccattgacagcaacattcccagcacaatcggcgtcttgcgcgcgatattcaggaagccagtacgacgcatcagccagtcggaaatgatgccgcccaacacgccgccgataaagccgcagactgcaggaaccgaggcgacaaagcccgctttgagaatcgacatgccgcgcgcctggaccaaatagaccgggaaccaggtaataaagaaataggtcaatgcgttaatacagtactgaccgatgtaaacgccaatcatcatacgagagcccagcagctgtttgatctggccccatttgacgctaaacggtactttcgctttggtgtctttctgatccatattgatcagcgcgccgccttctgcgatgtactccaattctttcttatttacgcccggatggttatttggttcatggataactttcaaccagataaagctgatgatgatccctaacccgcccataaagaagaagacatgcgaccagcccacttcgtgcgtcagccagcccataatcggcgcgaaaataaccgtggcaaagtattgcgcggagttaaagatggccaccgccgttcccctctcctgcgccgggaaccaggccgcaacgatgcgactgttgcccgggaaagaaggcgattccgccagaccgaccaggaaacgaagcgtaaagagggcgacaataatgccgaaaccactaaagatatcgacaaaaccctgcaacagggtgaagactgaccaaatgaaaatagaccagaaatagacgcgtttggaaccaaagcggtccagcagccagccgcccgggatctgcccgataacataggcccatgaaaaagcagaaaaaacatagcccatacctaccggatcaaggccgatatctttggccatttctgagccggcaatggacaatgtggcgcggtcgccgtagttgaaggatgtgacgataaacagcatcaccactatccagtagcgggcgttcgtgcgtttctccgcactgctcgccgcgtgacttaatgaactcattgttgcactcctgaaatttcgcgttagctacgctcactctgaactgcacaaccggtagggaatcagagataacgtttccttgttgcagcttttattaggtcgtttgctttgcacgctgcatgcttttattcactggcaggagaagtataaaaagcgcgccacacacactcaccgtgcaacaacacagtattttggcgatgaattacgcctgtttatggcaaaagcccaggacagtggaagccacttcacggaaatgaaatcagaaggcgtcggcgtcgacgcaggaggagtaaaaagagaagaatgtgaaacaggtcgcttgattacatgaaaacgcccgtaaaaaactgccgcttttgcgggcatatgcccaaagctaacacgattcagttactttacactgtgtacaggtcgtgattttgcttactggcaacgcaagcaaacgaaaaggtaccctcccgtaggggggagggatttacctcaggaaagtaaagttccccagttttcaacccagggattggattggctctccggctccggatgttcgctggcgtcaatgaataatatctcccccacccgctgcgcgctttgctcttgcaacagggcatcaaactgtttgccgccattacagaaattggggtagctgctatcacctagcgcaatcaccccgtaacgcaggtttggctgaaaacccaacgtatctttaatgccgtgaaagagcggcgcaatgctatccggtagatcgccttgcccggtcgtcgaggtaacgaccagcgcaaccttatcctgatattgctgccagtcggacagttcaggatcttcaaacacggtcgcgctgtggccctgtctggcgaggatcgcttccgcttcttccgccaccagcagtgagttgccatacatggtcccgacaaaaataccaatttccgccattatgcgtatctccctgaattatgtcagatgagtctcatcctgccgggacgccgccgtaaactcaaccctttcattgtcagggagaagtccacgccagccaaactgtgtcagcacctgcatccaggtttcatccaacccggcctgaattatcaacggctgtccggtgaaggggtgcgtcagttcaagccgactggcatgaagcatcaggcgacgacaggcaaaatgctctgcggcgctgcggttttgtcgcaaatcgccatgcttgctgtcgccgatgataggatgacgcagatgcgccagatgacgacgaagctggtgcttgcgtcccgtttttggttccagctcaaccaggccataacgcgtggtgggataacgcccggtcggcaccgccatttcgaccgtcgccagcccgcgatactgcgttacagccggctggggcgctttatcttcgcgggcgaatttatcggcaattttatcgcgctcttccaccagcggataatccagtaccgcgtcatctatcagccagccgcgcacaatggcatggtagcgtttacggatgtggtgctgctcgaactgctgcgccagacggcgtcccgcttcgctggacagccccattaacagtacgcccgacgtgggcctgtcgagacggtgggcggtaaaaacatgctggccgatttggtcgcgcaccgtttgcatgaccacgactttttcgtcgcgatccagccagctccggtgaacaagccagcctgcgggtttattcacggcaaccagccacgggtcttgatagaggatctccagcatcaggatttatcgcggacgaatagcgcatccagatcctgcaaaaccgccaggatcgcctcccgctgcggatgatccgccgccagcgccatttcataataaggggcgacggcaaacgcctcgggcagcggctgcgcattatcaagtagggtatgcatacgtgggatcaatacccattgcagccattccagcggttccatggtatccataaaaaatggttgggtgctggtaaacaaatgcgcctgcggcgcatccagccgccagtggcgatgctcgcgcagcagcgtttcaagcgcatgtaactgctgacgcacacggtcatgagtcgtcatgttaaaacctcaatgatgaaaatctggcgcgaagaataacaaaaaaagggagcactgtataaacagtgctcccggttcgtttcgcagcattccagctacttttcgtgctccctgctcatccgtgacaacttttcctgtgaccttacggcctgttcatcctgaacgtttacatcctgcgcacatcgcccgatgtgatagcttcatcctgaagcgtccctggttatccagatccgccgaacatcctgatcggctctcgttctccgtcctggaggtgtcctttaacgcatcctgcgctttccactttgcttcatcctgaagcctttccttgtaacaccatcctggcgtgtcctgctgaagcgtcatcatcctgacgttcgcttcgttgtacgactccctgtcgacgaagatagaatcgcctgtttcaccttgtcttacaagacgcttacagacaataccttaagtaaattttcatatgaaagtgcgcaaaaacattttaattagttgttttatatagacttacataagaaaacggggctcagtatccgctgatatcctggcgatctcctacagactttgtaagagatctctcacacccgttagggcaaacgattacagaagaggattaagttgcgtaaggaattccgcaagcgttgcggcaagaacggtacgattgcgggtgcccagcgtttctttaatcacctcgccggacagattacagaccgaaatgacctcaagctcattttcctgcgtcgcaataaaaagcgtgggaggaagcttgagccgcttttgcgtgaccaggtggcctatcagattttcctgcacgcgccgaaagtcatcctgactccaggtttgcagtagcgtaagcttttcatccgcaaactgcgcgggcatgtcgccagcaaactgcgtggtgtaaaacgcgtggagcgcaggttgtaccataatatcaaaggcgcgttcaaccgcgtttacattttcttcgccttcaaaaggctgcggctgccagtaaacggcatcgcgggttgaagaaataatgcacggagaaggtacgccatacagttcttcgctcaacggccagctaccgtgtttttcttgccacgcgtcgcagtaacgcgtcgtaaaggctttcaatgcctgcgctgtcagttcgtccaccagtttctctcttcataaaagccaggatacacttgacgcatagtgtatctggtttatgacggtgaaacatgtcttcttatgaaaaccatcaggctctcgatggcctgactctcggaaaatcaacggattaccgggacaattatgacgccagcctgctgcagggcgtaccgcgcagtttgaatcgcgacccgctcggattaacagccgataatttgccgttccacggcgcggatatctggacgttgtatgaactttcctggcttaacagccagggtcttccgcaggtcgccgtcggacatgtcgaactggattacaccagcgttaatttaatcgaatccaaaagttttaaactgtatctgaacagctttaaccagacgcgctttgacacctgggagacggtgcgccagacgctggagcgcgatctgcgcgcctgcgcgcagggcaacgttagcgtgaggcttcatcgtcttgatgagctggaaggacagcctgtcgcccatttccacggcacctgtattgacgatcaggatatcagtatcgacaactaccagtttactaccgactatctgcaacatgcggtcagcggcgagaagcaagtagaagaaacgctggtcagtcatctgttgaaatccaactgcctgatcacccaccaaccggactggggctcgatacaaattcagtatcgcgggcgcaaaatcgacagggaaaaactgctgcgttatctggtctccttccgtcaccataatgaatttcacgagcagtgcgtagagcgtattttcaatgacattctgcgcttctgccagccggaaacgttaagcgtttatgcacgctatacccgccgcggcgggctggacattaatccctggcgcagcaataccgattttgtgcccgccacgggcaggctggcgcgtcagtaatcttttttgtcaattttgcgtgccggattgcgcatgtaaggttgtgaaaggtcatcagccagggctattgtaatcaacagggaatggcgtgttgcgtcccataaggagtttacttgattacacatattagcccgcttggctcaatggatatgttgtcgcaactggaagtggacatgctgaaacgcacggccagtagcgacctgtatcaactgtttcgtaactgttcacttgccgttcttaactccggcagcctgaccgacaacagcaaagagctgctgtcctgctttgaaaatttcgatattaacgtactgcgccgcgagcgcggcgtgaagctggaattgattaatccgcctgaagacgcctttgttgacgggcggattattcgtgcgctacaggctaacctgttcgcagtgctgcgcgacattctctttgtgaatgggcagatccacaatgccggccgtttccagcatctggatcttgaaagctcaacacatatcaccaatctggtgttctccattttgcgcaacgcccgggcgctgcacgtcggcgaagcgccaaacatggtggtatgctggggcggccactcaattaacgaaaacgagtacctgtatgcccgtcgcgtcggcacgcagttgggattacgcgagctgaacatctgcaccggctgcggccctggggcgatggaagcccccatgaagggcgcggcggtcggtcacgcacagcagcgctataaagacagccgctttatcggcatgactgaaccttccattattgcggctgaaccgcctaacccgctggtgaacgaactgatcatcatgccggatatcgaaaaacgcctggaagcgttcgtccgtatcgcacacggtatcatcatcttcccgggcggcgtgggtacggcggaagagctgctttatttgctggggattctgatgaatccagccaataaaaatcaggtgctgccgctgatcctgaccggaccaaaagagagcgccgattacttccgcgtgctggatgagtttattacccatacgctgggcgaagcggcccgccgtcattaccgcatcatcattgacgatgcggcggaggtagcgcggctgatgaagaaagcgatgccgcaagtgaaagagaatcgccgcgatactggcgacgcctatagttttaactggtcgatgcgtattgcaccggatctgcaggtgccgtttgagccgtcgcatgagaatatggccaacctgaaactgtacccggatcagccggttgagattctggcggcggatctgcggcgcgccttctccggtattgtcgcggggaacgtgaaggaggtcgggatacgcgccattgaagctaatggtccgtataaaatccacggcgatcgagagatgatgcgtcgcatggacgatctgctgcagggattcgtcgcgcagcatcgtatgaaattgccgggttccgcctacatcccctgttacgagatctgcgcttaacgcttatgcccggttgccgccagcagccgggcgcttctcccattcctttcattgcggtatggcgattcacgtatgccttcattttttatgatgatcatcagaggtatagcccgcattgttttataaacaccatttataatttaccataaatagattgccaggcaaacgtttacctgactcctcttaccgtgatttatcggttcaaactctcattcttcgcaagaatccactaaaaaccttgatttttatagtcaaacctccgtatcttgcgccccaatctttccggccttatatcgttaatggtagccttcgcgcccggaaattcgttatgacgtttttttaatagattaatggtccaaatttatccatgtaagaagcggattattgcatttgagatcgggatcactgatagattcatcacttaaatgtatctttccgcccgaaaattattacggcgaaaaattatataaaaagcgtccctaagcagatttcattttacgatcaggtcttttttcattggattagaccagcaacctgatttttagcatcctccaggagaaatagatgaaaaccactcagaccagcacgattgcttcgattgactctcgaagcgcatggcgcaaaacggataccatgtggatgctgggcctttacggcacggcaatcggcgcgggcgttctgttcctgccgatcaacgcaggcgtcggcggcatgattccgctcatcatcatggcgattctcgctttcccgatgacctttttcgcacaccgtggtttaacccgcttcgtgctgtccggtaaaaacccgggtgaagacatcactgaagtcgttgaggaacacttcggtatcggcgcaggtaaactgattaccctgctctacttcttcgcgatttaccccatcctgctggtttacagcgtggcgattactaataccgtggaaagcttcctgacccaccagttagcgattaatccgccgccgcgggcgattctttccctgatcctgattgttggcatgatgaccatcgtgcgcttcggcgagcaaatgatcgttaaggcgatgagtatcctggtattcccgttcgtcgctgcgctgatgctgctggccttgtacctgatcccgcagtggaacggcgcggcgctggaaactctgtcctttgattccgccgcgtctaccggtaacggtctgtggatgacgctgtggctggcgattccggtgatggttttctctttcaaccactccccgatcatctcctccttcgcggttgcgaagcgtgaagagtacggtgaaggcgctgagaagaaatgttctaaaattctggccttcgcccacatcatgatggtgctgaccgtgatgttcttcgtcttcagctgcgtgctgagcctgacgccggcagatctggcagcggcaaaagagcagaacatctctattctgtcttacctggcgaaccactttaacgcgccgatcatcgcctggatggcgccgatcattgcgatgattgctatcaccaaatccttcctcggccactacctgggcgcgcgtgaaggctttaacgggatggtgattaaatcgctgcgtggtaaaggtaaatccatcgaaatcaacaaactgaataaaattaccgcgctgttcatgctggtcaccacctggattgtggcgacgctgaaccccagcatcctgggcatgattgaaaccctgggcggcccgatcatcgcgatgattctgttcctgatgccgatgtatgccatccagaaagtaccggcaatgcgtaagtacagcggtcatatcagcaacgtattcgttgtgattatgggcctgattgccatctccgctattttctactcactgttcagctaagtcctttagcgccgcttaccgcggcgcttctctatgatacaaccgcaatggatgccctatgattagcgtattcgatatttttaaaatcggcattggcccttccagttctcacaccgtcggaccaatgaaagcaggcaagcagttcacggacgatctgattgcccgccatattcttacagatgtcacccgcgtcgtggtggatgtctacggctctctgtcattgacgggtaaaggccaccacactgatatcgccattattatgggcctggcggggaatctgccggacaccgtcgatatcgacgccattccgtcctttatccaggatgtgaacacccatgggcgtttactactggccaatgggcagcatgaagtcgaatttccggtcgataagtgcatgaatttccacgccgacaacctgtctctgcatgagaacgggatgcgtattaccgcgctggcgggcaataaagtgctctacagccaaacctactactccattggcggcggctttatcgtcgatgaagagcactttggtttgacaaatagcgaacccgttaacgtaccgtatccttataaaaccgccgcggatttacagcgccattgccaggagacgggtctgtcgctctccggtctgatgatgcaaaacgaactggctctgcacagtaaagaagcgctggagcagcacttcgccaaggtctgggaggtgatgcgcagcggtattgagcgcggtatcaccaccgagggcgtattgccgggcaaactgcgcgttccgcgtcgcgcggcggcgctgcgtcggatgctggtcagtcaggataagaccaccaccgatccgatggcggtcgtcgactggatcaatatgttcgcgctggcggtgaacgaagagaatgccgcaggcggacgagtagtcactgccccgactaacggcgcatgtggtattgtgccggcggtgctggcgtactatgacaaatttatccgcgaagtaaatgctaactcacttgctcgctatatgctggtcgccagcgcgattggctcgctgtataagatgaacgcctctatttccggcgccgaagtgggttgtcagggagaggtcggcgtggcctgttccatggcggcagcgggtctggccgagctgctgggcggtagtccggcgcaggtgtgtatcgccgcagaaatcgccatggagcataatctggggctaacttgcgatccggttgccggtcaggtccaggttccctgcattgagcgtaacgcgattgcttcagtcaaagcggtcaacgccgcgcgtatggcgctgcgccgaaccagcgaaccgcgcgtatgcctcgataaagtgattgagaccatgtacgaaacgggtaaagatatgaacgctaagtaccgcgaaacttcgcgcggcggcctggcgatgaagatcgttacctgcgattaattctcagcacattttaggatctgtaggccggataaggcgctcgccgccatccggcttttgttgcctgatggcgcttcgcttatcaggtctacggatagcgcgatttcgcaatgctcgcctccccccgccgtgaatgttaccctacgcgcaggtttgtaagggagaacaccgtggctgctcatctgcttatcgtcgacgcgctcaatttgattcgccgtattcacgccgttcagggatcgccctgtgtggaaacctgccaacacgcgctcgatcaattgattatccacagccagccaacccatgccgtagcggtatttgatgacgacgcgcgcagcagcggctggcgtcatcagcgtttgccggactacaaagcaggacgtccgccgatgcctgacgatttacataatgaaatgcccgccctacgcgccgcgtttgaacagcgcggcgtacgctgttgggcatcagacggtaacgaagcggacgatctggcggcgacgctggcgctaaaagttaccgaagccggacaccaggcaaccattgtgtcaaccgataaaggctattgccagttgctctctccgggattgcgcattcgcgactacttccagaaacgctggctggacgcgccgtttattgaaaaagagtttggcgtactcccccggcagttgccggattactggggtctggcaggaatcagtagttcgaaagtccccggcgttgccggtatcggccctaaaagcgcgacccagctgttggttcagtttcaaaatctggagggaatttacgcccatctggacgaggtgccggaaaagtggcgcaaaaagcttgagacgcataaagaaatggcatttctttgccgcgatattgcacgtctgcaaaccgatttacatatcgacggaaacttacagcagctacggctggtacggtagttttgttgccggatggcggcgtgaacgccttatccggcctacagaactgcacgaaatgtagagcggataagcgcagcgccatccggcaaaattaccaggcggtatgatacagttcgacaatgtccgccagactcgcttcacgcggattgccgcccgtacagacatcatcgaacgccgcctgcgccagcgccgggatatcctcttttcgaacgccgacatcacgcaaatgcagcggaattcccacatcgcgatttagcgtaaatacggcttccactgcggcattacgcgcctcttcaaggctcaatccttctaccttcacccccatcgcccgggcgatatcacggaatttctcgttggtagacccggcattgaaacgcatcacatgcgggagcaaaatagcattcgcgacgccgtgcggcgtgttgtaaaacgcgcccaacggatgcgccatcccatgcaccagtcccagccccacattggaaaaccccatcccggcaacgtattgccccagcgccatcgcctcaccggcctctttttctccggctacggcgccgcgcagcgcgccagcaataatctcaatggctttgatatgtaatgcatccgtcagcgcccatgcggcccgggtaatatagccttcaatagcatgggttagcgcatccacgcccgttgccgctttcagcgcgggcggcataccgtccatcatatcggcatcgataaatgccgcctgcggaatatcatgcggatcgacacaaacgaatttgcgccgtttctcttcatcggtaatcacataattgatagtgacttccgccgcggttcccgccgttgtcgggatcgccataatcggcacgctgggtttacgggtcggcgatagcccttccagactgcgcacatcggcaaattccggattgttactgataataccgaccgctttgcaggtatcctgcggagaaccgccgccaatggcgatgagatagtccgcgccactttgggtaaagaccttaagcccttcctggacaacggaaatcgtaggattagggatcacgcccgcatagatctcccacgccagccctgcggcatccattctgcttgtaaccttatcgaccacaccgcattgcaccagcgttttatcggtaacaatcagcgccttatgataaccgcggcgcgtcacctcatcggttaatgcgtccaccgctccccggccaaaccatgccgtttcattcagaatcattctgttcgccatcgcctgtctcctgacatcactcttcaatacgtaatccgtaagttttaaatttctccagtacgatagcgatcgcctcgtcatccagtaccggtaccggatcgacaatggccagcgtacttaaatagagctgcgccagcacttccacttcatgcgccagccacaacgctttgtctaaattttcttcacaagcgataagcccgtgatgctgtaacagcgtcgctttacgatttttaagcgccacggcaacatggtcagaaagttcgcgggtgccaaaagtggcgtagggcgcgcagggaatagagttcccccccgcggcggcaatcatgtagtgaatcgccggaatcgggcgattcaggatcgagactgccgtacaatggacagcgtggttatgtaccacggcattggcgtcagggcgcgtctggtatgccgccatatgaaaacgccactcgctggaaggcagcttgccctgctcatgctgaccgtctgcatcaataaagacaatgtgcgactctgtcagcttctcgtaggggatccccgtcggcgtaatcagcattccgccctgataacgtacgctcacgttacctgccgtcccctgatttaaccctaaccgcgtcatttccagacaggtatcaataatctgccgagccagtctatttcgttccattatttacctctctctgtgattcaaaatgagacaacaaaaccgcctttcgcatcacgctgctgtcctgttgaaataatcgaatagttagcaactatcatcatactgaataaagagaagggaatttaaataacaatattttgtgatacacatcaattaattcgccacgataaaccagacgactgccatttctctcgccgataaatgcccgctcttaataatatttttcaaaacgggcaaagatgaaaaataagttaccactgaccgttttcgtagcaataatttaattcgggcattcagcctgtggttttttaaattaaacatttcaaacggtcatttttttatgaaaattaaagtgatgataatcacagaacgctatgctctcaggtataaatgtgaccgccatcatattaaaaggccttttttatttgaaaatgactccatgagttcattccggacgccaatttattaccggtaagaaaagcgaactcacctaattttacggtctggtgaccagaaccgaccgcacgcaaaagcttctgaaccgatgaggatgctatgggaaacacaacaatacaaacacagagttttcgtgctgtggatgcagagcaaagcaaaagcaagcgctacattattccattcgccttactttgctcgctattttttctgtgggccgtcgccaataatctgaatgacattttattaccgcagtttcaacaagcttttacgctaactaacttccaggccggacttattcagtcagccttttatttcggttatttcgtcattccaattcccgctgggattttgatgaaaaaactcagttataaagcagggattatcactggactttttttgtatgcttttggcgccgcattattctggcctgccgccgagataatgaattacacattatttttaattggcctgtttatcatcgccgccggtttaggctgccttgaaactgcggccaatccttttgtgacggcattaggtccagaaagcggcggacatttccggcttaatctggcgcaaacttttaactcctttggcgctattatcgccgttgtgtttgggcaaagccttattttgtctaacgtgccgcatcaatcacaagaagcgcttgataaaatgacgccggatcagcttagcgcctataaacacagcctggtgttatcggtacaaacgccatacatgattatcgtcgccatcgtattagtagttgcgctgctgattatgctgaccaaatttccggccctgcaaagtgacgatcatagcgatgctaaacaaagctctttcttatcttctctctcccgactcatccgtatccgccactggcgctgggcggtgctggcgcagttctgctacgtgggggcgcaaaccgcctgctggagctatctgatccgctacgccattgaggagatccctggaatgacgcccggtttcgccgccaactacctgaccggcacgatggtgtgcttctttatcggccgtttcaccgggacctggcttatcagccgcttcgcgccgcataaagtgctggccgcctatgccctgcttgccatgctcctgtgtctgatttccgcctttagcggcggacatatcggcctgctggcgctgacgttgtgtagcgcatttatgtcaatccagtacccaaccatcttctcgctgggtatcaaaaatctgggacaggacactaagtacggctcgtcttttatcgtcatgaccattattggcggcggtattgtcacgccagtaatgggcttcgttagcgacgccgcaggcaaaatcccgaccgccgaactggttccggcattgtgctttgccgtcatcttcatttttgcccgtttccgttcacaagcggcgacaaactgaacatttatccgaataacgtgaggaatctgtcatgaaaaaaatcagcttaccgaaaatcggtatccgcccggtgattgatggacgttgtatgggcgtacgcgagtcgctcgaagagcaaaccatgaacatggcgaaagcgacggcggcgctcatcaccgagaaaatccgccacgcctgtggggcacaggtggagtgcgtcattgcggatacctgtattgccggaatggcggaatccgccgcctgtgaagaaaaattcagtagccagaacgtgggcgtgaccattaccgttacgccgtgctggtgctatggcagcgaaaccattgatatggacccgatgcgtccgaaagccatctggggctttaacggcacagagcgtcccggggcggtttaccttgccgcggcgctggcggcgcacagccaaaaaggcattccggcgttctccatttatggccatgacgtgcaggatgccgacgatacctccattcctgccgacgtcgaagaaaaactgctgcgttttgcgcgggcagggttagcggtagccagcatgaaaggcaaaagctacctctccgtcggcggcgtgtcgatggggatcgcgggttccattgtcgatcataacttctttgaatcctggctgggcatgaaggtgcaagcggtagatatgaccgaactgcgccgccgtatcgatcaaaaaatttatgatgaggccgaactggagatggcgctggcgtgggcggataaaaacttccgctacggcgaagatcaaaacgcctcgcagtataagcgcaatgaagcccagaaccgcgcggtgctaaaagagagcctgctgatggcgatgtgtattcgcgacatgatgcagggcaacaagacgctggcggacaaagggttagttgaagaatcgctgggctacaacgccattgccgccggcttccagggccagcgccactggaccgatcaatacccgaacggcgataccgccgaagcgctgctcaatagctcttttgactggaacggcgtacgcgaaccgtttgtcgtcgccaccgaaaatgacagtctgaacggagtagcgatgctgtttggccatcaactcaccggtaccgcgcagatattcgccgacgtgcgaacttactggtcgccggaagccgtagaacgcgtcaccggccaggcgctcagcgccctggcggaacacggcattattcacctgattaactccggttctgccgcgctggacggtgcctgtaaacagcgcgacagcgaaggcaagccgaccatgaaaccgcactgggaaatcagccaacaagaggcggatgcgtgtctggcggccactgaatggtgcccggcaattcacgaatacttccgcggcggcggctactcatcccgttttctgaccgaaggcggcgtgccattcaccatgacccgcgtgaatatcatcaaaggcctgggaccagtactgcaaatcgccgaggggtggagcgtcgaactgccgaaagcgatgcacgatcagcttgatgcccgcaccaactctacctggcctaccacctggtttgcgccgcgtcttatcggcaaaggtccgtttaccgatgtctattcggtgatggcgaactggggcgctaaccacggcgtactcaccatcggtcatgtaggggcggactttattactctcgccgcgatgctgcgtatcccggtatgtatgcacaacgtggaggaggcgaagatctaccgtccttccgcctgggcggctcacggtatggatatcgaaggctaggattatcgcgcctgccagaattatggcccgctgtataaacgttaatgcggcttagcccggtggcgctggcttaccgggcctacgggcgcgtgaaccgtaggccggataagcgtagcgccatcaggcggcgtttatggagttatctatgaaacaagacgttatcctggttctcgactgcggtgcgactaacgttcgggcgatcgccgttgatcgccaggggaaaattgtcgcccgcgcctcaaccgctaacgccagcgacattgccgcagaaaatagcgcctggcatcagtggtcgctggacgccatcctgcaacgtttcgccgactgctgcaggtcactctccagcgccctgtcggagtgtgttgttcgcggtattacggtgactactttcggcgtcgatggcgcgctggtcgatgcgcagggtaagctgctctacccggtcatcagttggaaatgcccgcgaaccgctgccgtgatggaaacgattgagcgctttatctcgccccggcaattgcagacgctctccggcgtcggcgcgttcagctttaacacgctgtataaactggtctggcttaaagagaatcatccgcgcctgctggaacaagctcactgctggctgtttatctcgtcgctgattaaccaccgtctgaccggagagtttacgaccgatatcactatggcaggcaccagccagctactggatatccatcagcgcgactttagtccggaaatcctgcaggcgacgggcctggcgcgccgcctgttcccgcgtatcgtggaagcgggcgccccgataggcacgctacagacagacgcggccaggctactcggtctcccggcgggtgtgccagtgatctctgccgaacacgatactcagttcgcgttattcggcgctggcgcgcagcaaggtgaaccagtgctctcctccggaacatgggagattctgatggtgcgcagcggtcaggtggatacctcgctgctcagtcagtatccgggctcgacctgtgaactggacagtcagtcggggctttataaccccggaatgcagtggctggcctccggcgtactcgaatgggtacgaaaactgctgtggacgccggaaacgccatggcaaacgctgatcgacgaagcgcgcgctattcccgctggcgcggaaggcgtgcggatgcagtgcgatctgctcgcctgtcaaaatgcaggctggcagggcgtgacgctcaataccacccgcggccatttctatcgcgccgcgctggaaggcctgacggcgcaacttcagcgtaatctgcgcacgctggagaaaatcggccattttaacgccacagaactgttactggttggcggcggcagtcgcaacgctttgtggaatcaaattaaagcgaatcaacttgatatccctatcaaagtgctggacgacgcggaaaccaccgtggccggcgctgccatgtttggctggtacggcgtaggcgaatttagtagcccggagcaggcgcgtgcgcaggtcaattatcagtatcgctatttctggccgcaaaccgaacctgaaattattgagggagtatgaaatgctaaaaaccatttcaccgttaatttccccgacactgctcaaagtgctggccgagatgggccacggggacgaaatcattttttctgacgctcactttcccgcgcatagcctgggcccgcaggtgattcgcgccgatggtcttagcgtcagcgatctactgcgggcaatcattccgctctttgagctggatagctacgccccgccgctggtgatgatggccgccgtagaaggcgacacgctcgaccccagcgttgaagcgcgttatcgcgatgctttgtcattagaagcgccgtgcccggatatcgttcgtatcgaccgctatgcgttttatgagcgggcgcaaaaagcgtttgcgatcgttatcacaggtgagtgcgcgaagtacggaaatattcttttaaaaaaaggggtaacgccgtaatctcttgccggtgcgcccgcatgacgcgggcgttcatcgaatgatggggtgagaaaaatgaaagcggcacgccaacaagcgatagtcgatctgctgatcaatcataaaagtctgaccaccgaagcgctggccacccggcttaacgtcagtaaagagaccatccgccgcgatctcagtgaactacagacgcagggaaaagtgctgcgtaatcacggacgagctaaatatattcatcgtgaaaatcaggacagcggcgatccattccatatccgcctgaaaagccattatgcgcataaagccgatattgcccgtgaagcgttagcgtggatagaagaaggaatgacgattgcgctggatgccagttcaacctgctggtatctggcccgccagttgccggatattcccattcaggtttttaccaatagccatcctatctgtcaggagctgggaaaacgcgaacgcattgcgctgataagttccggcggccagcttgaacgtaaatatggctgttacgttaatccgtcgcttatctcacagctaaaatcgcttgatatcgatctgttcatcttttcctgcgaggggatcgacggcggcggcgatctgtgggactccaatgcgatcaacgccgattttaaatctatcctgctcaggcgcgcctcgcagtctttattattgattgataaaagtaaatttaatcgttcaggagaggcgcgcatcggccatctggatgatgtgacgcatatcgtttcagatgcgccgcagtcataggccggataagcgtgcgccatccggcgctgatgacgcgccggatgacggcagcgcgtttttatcgctcgtcgcgacgtccgccaacagccgcccacaaccgacgcacgtgtaccgtcacttcttcgcgatcgtgataaagctgacgcgcctggatctgcgcattaacgccatgctcatccaactgcgcctgaagatacgccaggttatgcgatacctcttcatagcgttttttcatcggcagtttaaggttaaaaatcgtctcccgacaccagccgttcaccagccactgcgccattaacgcggtgactttggccggcttctccaccatatcgcagaccatccatgaaatattattccggttcggacggtacctgaagccatcctcacgcaaccaggtcacctgtccggtgtccatcaggctttgcgccatcgggccgttatctacggagtagacccacatattgcgcttcactaactggtacgtccatccgccgggacaggcgcccaaatccaccgcgtacatgccgtttgccagacgttcatcccactcatcttccgggatgaaaacgtggagcgcctcttccagtttcagcgttgagcggctcggcgcatcagacggaaacttcaaacgcgggatgcccatataaaacggtgaattgttatgcgcgaacgaataaccggtatagcagcatcctggcgcgataaaaaagacatgaacgaccggacgcttcggcgtttcataattcgtcaatacgcccgcatcacgcaaagccgcgcgcagcggcaccgtaaatttgcggcagaacttcatcagttctttactttcattggtgtcggcgacttcaacccgcagctcgccgcccttttccactacgccctgcaacatgccgacaatcggcgtgattctgtcttccggcggtaaatgttgcagcagttcacccaccacaaaccactggcgggcgaaaatcagcgaactgaacggcagttctgaaatcagcttttcgccatcttccggctggtagcattcataaatgacatagcctgcgttctcttttacgcgtgcaaaaccaaatatttcccgttttcccgctttatcggtaatttctgcagcgcactctttttcaaaccccggacggcagagcaagacaactttattcatggctcgcgcccttacgtttcatacgaatggcgccaatcagcaatagcgcccagcccaccaggaaactgacgccgccgacaggcgtgatatacgcccacaggcgcagatgcgaaagcgcaaggcagtacaggctgccgctaaacagcaccgtgcccagcgccagaaaaacgctgctccagtaaaaccagatgctgatacggcgctgcatcgccaccgccaggccaaagatcgccagcgtatggaacgcctgatattgcaggccggtctgaatccagcccatttcaaccacgcccagggttttactcaaaacatgcgccccgaacgcgcccagagcaacgtaaataaaaccgctgatagcggcgacaatcagcataaaacggctggtcatggtcataccctaagttaattattgttcgtaacgaaaacggaatttttcttgctccgtcgccgccttcgccaaaatccactgacggaaggcggctattttacccagttctgcctggctgtcatgacaaaccagataaaaagcattcttactcaccagaacatcgttaaatggacacaccagtcgcccggcttcaatttccgactgcgccataacattattcgccagcgcgatcccctgtccgtgaatagccgcctgtagcaccatcgcgctgtggctaaatatcggcccttgctgaacgttaatatggttgagccctaactgacgagtataggcctgccagtcacgccgggaggcatcgtgcaataacgtatgtttcgccagatcctccggcgtttttaacggtttttcgcctgtgagcaataaaggagaacagacgggcaataaatattctgcgtataatttttcgacgcgcaagcccggccagtttccccggccataaaaaatcgcgacatcgacatcgtctgccagtttatcttcctgacgatcaacggcttgtatccgaacgtcaattcccggataagctgagttaaagctggagagcctgggcaccagccactggatggcaaaactgggcggtaaactcaccgtcagcgcccctttggcactgcgcgcctggagcttacgcgttgcttccgttagctgggaaaatatctctttaatatcaagaaaatagctttggccttcttccgtcagcagcagcgaacgattgcggcggcggaacagttttagccccaaaaaatcctcaagtgacttaatttggtggcttactgcggcctgcgtcacaaaaagttcttccgctgctcgcgtaaaactcaaatggcgcgcggcagcatcaaaaacgcgtaacgcatttaaaggaggtaatcgttttgacatggcctctggacttaatgtcgaatgaatttaacaaataggtaacaataggtaacctattagtttttttaatctgagacattataaattgtccgttgaggttctaccagcaaatacctatagtggcggcacttcctgagccggaacgaaaagttttatcggaatgcgtgttctgatgggcttttggcttacggttgtgatgttgtgttgttgtgtttgcaattggtctgcgattcagaccacggtagcgagactaccctttttcacttcctgtacatttaccctgtctgtccatagtgattaatgtagcaccgccatattgcggtgcttttttttgtataacaaacggttagttttccagagccaccatctctttcacgtcagtacgattgatctgctgtttgttgccattagcgtctttatacgaaatcataccggtatcgttatcggtctggggtttaccgtcggtcacaatgctacgtccatcattggtgtgcataacgtaattaggaccggaacaggcgctcagggcaaaagtcagcatacatgcagagataattgcggcagtctttttcatcttcttctccttaaagctgtttgtgctatttaaagcggactccgtaacaggcttaaacattcgcctaacattattcagcataacctcctttacataattcgccaggatatacagacgattccgatggttaggacaaaccttgtatcagccgcgcttttacgccacgatcggtaaactgaaccgaggaatatcatgaacgcttttaatcccacgcagtttcgcgcgcagtttcccgcgctagccgatgcgggtgtttatctcgatagcgccgccacggcattaaagccacaggcagtcattgacgccacgcaccagttttattgtttgagcgccggtaacgttcatcgtagccagtttgcgcaggcgcagcgcctgacggcgcaatatgaagcggccagagcaaaagcggcgcggctgttaaacgcgcccgatgaaaaaagtatcgtctggacacgcggcaccaccgaagcgatcaacatggtggcgcagtgttacgcccgtcctcgtctgcgccccggcgatgaaattatcgttagcgtcgccgagcatcacgccaaccttgttccctggctgatggtggcgcaacaaaccggcgcgcaggtcataaaactgccgcttaatgaccgacgtcttcctgatgttgagcgtctgccggaactgatcacgtcgcgcagccggatactggcgctggggcaaatgtcgaacgtaacgggcggctgtccggatctcacaggcgctatcagcgccgctcacgcggcgggaatggtcgtgatgatagatggcgcgcaaggcgctgtacacttcccggcggatgtccagcagcttgatatcgatttttatgctttttccgctcacaaactgtatggcccgaccggtatcggcgtgctgtacggtaagccggagcttcttgaggcgatgtcgccctggctcggcggcggcaagatgatccgtgacgttagctttgaaggcttcaccactcaaagcgctccctggaaactggaagcggggacgccgaacgtcgccggggtcatcggcctgagcgctgcgctggaatggctgtccgatatcgatattgaacaggccgaaaactggagccgggggctggcgacgctggcggaagacgcactggcgaaacgtccgggctttcgttcgttccgctgccaggactccagcctgctggcctttgattttgtcggcgtgcaccacggcgatatggtgacgctgctggcggaatacggtattgcgctccgggccgggcaacattgcgcccagccattgctagcggaacttggcgtcacagggactctgcgcgcctcttttgcgccgtataatacccaacatgatgtggatgcgttggttaacgccgttgaccgcgcgctggaactgctggtggattaatgacaaaccctctttataccggacacccgttcggcacaacggtaacggaagagacgttacgcgctatctttctcccgctgacccaatgggaggataaatatcgtcagttgattctgttaggaaaacagctccccgctctgccggatgaatgcaaagcgcaggcgaaggagatagccggctgcgagaaccgcgtctggctgggctttacccgatcagataacggaacgatgcactttttcggcgacagtgaggggcggattgtccgcggcctgctagcggtattgctcaccgcggtggaaggaaaaaacgccgccgagttgcaggctcgttcaccgctggcgctgtttgatgagctgggtttacgcgcccagcttagcgcctcacgcagtcaggggctgaacgcgctgagcgaagcgattgttgccgcaacgcataagggttgaaatagcgtaaatattctgtcgcctgacagcgccgtccgcggcggtcaggcgatgcagataaaataatccagtcactttattagtttcggcatcagatttccctgataaacattcttttgatttttatcagctatcacaatgaaattacaatgttagaatccatgttaaaatggcgtgaagattttagagtaaataaaaccactcgatgtagcgtagcaggagaactggaaaattcatacgcatcgggtgaagttataacaggatatggataagtggaaaaatatctgcgtagcggtaccatgtttgtggtgctggcatttatattatgggggttaacacctttatattatcaatatttatcagggggaaatctcgcacaaatattgatataccgggtgttctggtcaattccattattactggcagtaaggttgttatttcggcagcgaacgcgatttcatgatgcctggaaagataaaaaatcctttttcttctgcatgatcgccggacttttgatgattgtctcatggtcatctttcatttatgcgctaacccatcatctggtacttgatgccagcctcggctattttatcaacccgctatttgttattgcgctgggatgcatttttcttaaagaaaaactgtcgttgtttcaggccatcgccgttttttctggtgtctgtggcctgacttttcaaattatcatgctacggcatttcccggcgctggcgctaaccatgggattatcatttgcgctatatggcctggcgcgaaagtttatacattatgatgtgatgacatcgataacgattgaaacattatgggcattgcctgtctcactattaatttttctctttagcgatactggaccaattatatccgctaatactcctttctttttgtatgtcatgacggcgccagtgacgatcattccactggtattatttgccatcgcgttaaatcacacctcgttgattgtcaccggactggcgcaatatatagagccgtctttacagttcttacttgccattatgatatttggcgagcacattaattacgcggaactgctctgcttttgtgcagtatggttcgggctgtttctatgcatatctgaaaatttatattcccattatctccgcgcccgtctgaaaccggtgttcggcagggtacagcgcttctttcgctaacaaagggcgcagggccggatacgcgtctgcgtgacactccgccccgtccttttattcttgtcgcgccgctttagccatgatcttcttcagcgcatgggaaacggcgacaaaaccgaacgttgccgttaccatcgtcgccgcgccgaagccagaggcgcaatccatccgttttggcccttctgcggtagctttcatcgcgcatacggaaccgtccgcctgtgggtaaaccagcgcttcggtggaaaaaacgcagtccacgcccagcttacctttactgttcttcactacgccaaaattatgtttcaatctctcacgcagttttgccgccagcggatcctggatagttttcgccaaatcagcgacctggatttgcgtcggatcgatctgcccgcccgcgccgccagtggttactaaaggaaccttatatcggcgacagtacgcaatcagcgcggcttttggacgaacgctgtcaatggcgtcaatgacataggtaaaacccgcgtccatataacccgccacattatccggcgtgatgaaatcatcgataaccgttacccggcactccgggttaatttgccgaatccgttcggccatcacttccgctttcgccaacccaacgttatcacgcaacgcatggatctgacggttcgtattggtcacgcagacatcgtccatatcaatcagcgtaatcgcgccgatgcccgtacgcgccagcgcctctgccgcccatgatcctaccccgccgattcccacgacgcagatatgcgcctcagcaaaccgctgcagcgctttttcaccgtacagacgcgcggtgccgccaaagcgttggcgccaggcatcacttatcaccactgacatatgacctcagaataaaaaaggtgaggttattcctcacccctgctcactattttcaggcccgatagcaatcgcgttatcgggcaatccggttgtcgcagaataccacaatcagccgctaaacacgttaccggcgcccggcgcgctttttaacacccagacgcgaccatagtgattataccatccggcacgatgcccggcatccgggccaatcccctggtaaatatcaaagtgctggcctttaatcgctccgccgacatccagtgcgaccatcaaacgtagctcatactgaccgctaaatttaccgttgttatccagcaacggtacttccgccaacaaggttgtgcccggcggaatgatgctgcggtcggaggcgacggatgctcgcccaatcagcggtacagcgctggcgcctttgaccggcgcaaaagattgcggtttaaagaagacgaacgacgggttctgctccagtaattcacgcacttccgcttcgctgtgcttctctccccattcgcgtatagcctgcatcgacatatcttcttttttcacttcaccgcgatcgataagcactttaccaatactgcgataaggccagccatttttaccggcataactaaagaagttcagcggactaccatcaccgaaatcaatataaccgctgccctggacatccataataaagttatccatcagcgaattactccaggccaggatgtacttatcgctcagcgcgcctgcgtagatctgggcgcgggacggtaagcgtccgcgttttggcggcatactatagatagggtactggaacgcgccctggcgcgtatggcgagcctgaacgacgggcgtatagtagcccgtgaactggacgttaccgtagttgtcggtgccttccatctgccaggcatcgataccaaactgacgcatagtgcgcgtatcgcctccggaacgtaaccagttctggacagcgttatagacgttgctttgattggtgtataaacgcggcgacgcggaacggatctggtcgacctgctcggcaaagtcaccagcattaatcggcgcgcccaccgcgtccggctggtttaccagggagaagggctgggtaaatttcccgtccttatattgctgaccgcgatcggtcggttttgatgaacaggcagccagcattgccagcattacgcctgtcgccacatattttgcccaacgtcctttcatggtgtctcgtcttctgcgtaatcgaaagtgcccggtgaagataacaaaccgtccgaagtaatgaaatgcgatcgcgatctcattatgtaaattcgtttaaaaatcgcgctatctgcggtgtatttgcgcaattcatgagaaattagcgatttatatgaaaaaagggttgcaacaaaagctcagcggagtatagtgcgcatccacggacgcggggtggagcagcctggtagctcgtcgggctcataacccgaaggtcgtcggttcaaatccggcccccgcaaccaattacaatgagaatgcaagtttagacggacgcggggtggagcagcctggtagctcgtcgggctcataacccgaaggtcgtcggttcaaatccggcccccgcaaccaacttaatgaacacccttacgggtgtttttttgtatctgtcatctggtccgcaacgacagtgcgggcagcatcctacttacccgcgcaataaactcgccgtcatctcaggttaacttcttctcgccagcgtcgccccatcggcaaaataggctttaatgcccgccagaatcgactctgcgacctgttgctggaacgtcgcggtcttgagcttgcgttcttcttcaatgttactgataaacgccgtctcgaccagaatagacggaatatcgggcgcctttaacaccgcaaaccccgcctgctcgaccttgtttttatgcaggtcattaattttaccaagctgcttcaacaccgctttaccgaatttcaaactatcggcaatggtcagcgattgcaccatatcgaacatcgtatggtcgacataacggtcaccgcttttgctcacgccgccaattaagtccgaggcgttctgcgtttgcgccagatatttcgccgcagtactggtggcgcctttagtcgatagcgcgaatacggatgaaccgctaggctgccggctggtgaaggcatccgcatgaatagagacaaacaggtcggcgcgctgtttctgcgctttcgccacccggacttttaacggaatgaagatgtcttcattgcgcgtcatatagaccttcatgttgccttctttttcgatcaacgcgcgcaggcggcgggctatctggagcaccacgtctttttcacgcgttttgtatttgcctatcgcgccagggtcttcgccgccgtgtcccggatcaagcataatgacaatgggacgatcgcgccccgctttaccgggctgcggcccgctttgcgaaggcggcacctgtttatccagatcgcctttattgtagtcttccagcagcgccagcagcggatcctgcatatcctgcgcattagcaggataaagatctatcaccagacgttctttaaagcctgccacaggcgccagcgcaaatagctgcggcttcacgttttgttttagctcaaagaccatacgcacagtcttaggatcaaactgccctacccttgcggatttgatatacggatcgtcgctgcgaatctgcgcgccaatgcctttaagcaccgagttcagattcacatcctcaatatctaccaccacgcggtccgggttacttaaggcaaattgtttatatttcagcagacgattcgactctaccgtgacgcgggtatagctggacgcaggccagatacgcaccgcaacgacctggcttacggcagccagcccgacctggctcacgcttaatagccacatggcgcccgcgccttgtagtaaacggcgacggctgattgctgaattggctcccgacatgcttctcccgagcaaaaactaaatagagatcatacaaagttcatccaaattgaccggaaactttagcgaatgacgcataatctgtcatctataaaagggtaaacattctttttatattcacggcattactaagaaaagcgatcggaccgcataaaatttacgcttgcacagagggcaaaaacagaataaaaatacactaatttcgaataataattcactagtggggcgcgcaatgataaaggaacgtaaaaccgaactggtagaagggtttcgccattcagttccctatatcaatacccatcgcggaaaaacctttgtcattatgctcggcggcgaagccattgagcatgacaatttttccagcatcgttagcgatatcgggctactgcatagcctcggtattcgccttgtcgtggtgtatggcgcgcgaccgcaaatcgacgccaatctggccgcgcatcatcatgaaccgatttaccacaaaaacacacgggtgacggacgccaaaacactggagctggtgaaacaggccgccggtttactccagcttgatattaccgcccgtctgtcgatgagtctgaacaatacgccgttgcagggcgcgcacattaatgtcgtcagcggcaatttcaccattgcgcagccgctgggcgttgatgatggcgtggactactgtcatagcggccgtatccggcgcattgatgaagatgcgatcaaccgccagttggataacggcgcgatcgttctgatggggccggtcgccgtctcagtgaccggcgaaagttttaatctgacctcagaagagattgccactcaactcgccgttaaactgaaagcggaaaaaatgatcggtttctgttcttctcagggcgttaccaatagcgagggcggcatcatttctgaactcttcccgaatgaagcgcaggcgcgggtggaagagttggaagcgcagggcgattacaactccggaaccgtacgttttttgcgcggcgcggtaaaagcctgtcgtagcggcgttcgtcgttgccatctgatcagctatcaggaagatggctcgctattacaggaattgttctcgcgtgatggtatcggtacgcagatcgtcatggagagcgccgagcagatccgccgcgctaccatcaacgatattggcggtattctggagcttatccgcccactggaacagcagggcattctggtacgccgttcccgtgaacaactggagatggagatcgataaatttaccattattcagcgcgataatatgactatcgcttgcgcggcgctgtatccttttgtggaagagaaaataggcgaaatggcctgcgtagcggtacatccggattatcgcagctcatcgcgtggagaagtgcttctggagcgggttgccgcccaggcacggcaaatggggctgcgtaaattgtttgtgttgacgacgcgcagtattcactggttccaggagcgcggttttacgcctgtcgatattgagttactgcctgagagcaagaaaaaaatgtataactatcagcgacgttcaaaggtgctgatggcagatttaggataacaaggggggcctgatggcgctgcgcttatcaggcctacgctcgaaagcatcatttggaggccggataagatgctacgcgtcgccatccggcgagaactcgtcttatccgatacgactgacttcatcaaataaggtggctaacccgctgcgccgttccgttcgcgtcacaatcgcgcctgccaggatccgttcatcggcatacagcgataaccgccgccgcgcccgcgtaacagcggtatacaccagctcccgcgtcacgaccggcgaacgttggctgggtaaaatcagcgcggcgtgatcaaattcagacccctgtgatttatgtaccgtcatcgcccaggttgtatcatgttccggcagacggctgggctgaacggacttgatcgtgccgtccggcatcacaaaccagacgcgtaacccctgcccgcgatcgagcgcaataccaatatcgccgttaaatagccccaacgcgctatcgttgcgcgcaatcattaccggacgcccttcataccagcgagagtgcggatgccgctgaatttttcgttgctgcaccatcgcctgctcaatgcggtcattcagtcccctcacgccaaatgggccttcgcgcagcgcacaaagcagttgatactcattgaaagcctgaaggattgcctccggcgccgctttttcatgcagcaaccgcaggtagcgcccatagcccgccagcgcttcatccagcatcccggcataatcgtcgctgctttgcaatgtacgcttctctatatcgctaaacccctgctgaaaaacagcctggattgccgacctgtcgccacagttaattgccgccgccagcttgccgatgccagaatcgctgccgaaacggtagctcttttgcaacaaacagaggctatcgcgtaaagacgcggcttgcgttccggcccccgccggaatggcgctaccagtgagtcgacttagctgtcgggcgcgttccgccgtaaaccctgcgttgacataggcgcaaatatcgcccaacacagcgcccgcctcaacggatgccaactgatcgcgatcgccaagaaaaatgacccgcccgtgcggcggcagagcgtcaatcaaacgtgacatcatcggcaaatcaatcattgatgcctcatcgaccaccagcacgtccagatgcagcgggttgcccgcatgatggcgtaatcgctggctgccgggctgtgcgcccagcagtcggtgcagcgtactggcgtcctccggtatacgctttttctgcgcatcggtaagaggaagctgacgcaacgccgcgccgagcgactccgtcaggcgtgcggccgctttcccggttggcgccgccagccggatacggcaacgttcgccatccgccatttgaattaatgccgccagcagcttcgcgacggtggtggttttaccggtgccgggaccgcctgaaatcacggagatacggcgagttagcgctacggcggcggccaccttttgccagttcacctcgtctgtcggagggaatagcgcgtccagaatacgggataactgatcttcatctacggcgatggcctggttaacctcgttaaaaaagcgcgcaaccgtacgctcgttgcaccacatgcgattcaggtagaggcgatcgccgcacagaattaacggcgcggggctatcgccgcagctaaccgccgcagacgccagtaaccgctttttccagtcgattggcgtagccgtttcgcttatccaggcgaccagtaagggatgcgcctcctccgttaacgttaaacgcgacaacggcagacacacgtgaccttcacctgcgtcatgactaagcagcgctgccgccagcgtcacggcgggatcgtcgttaccggcgacggttaaagcaaactgggcatcaatgggccgtaagagtttttgttcaacggcctccagcaaccgcttctggattgtcattgcgcctcctcactcatttcacctgcaaacatatcatccagttggttaattaacgccgccgcaggacgagtggtaaaaataccctgctgcggacgttcgctatccaccccgcgtaaaaagagatagatgacgccgccgaaatggcgttcatagtcgtaattcgccattcgatgacgaaggtaacgatgcaatgccagcgtataaagctggtactgcaaatcatagcgatgcgcctgcatcgccgcagccatcgccgtctgggtataagcggcgctatcctcgcccagccagttagatttatagtcgagcaggtaatagcgcccctcataacggaacaccaggtcgataaagccctttaacatgccgcgaacctgcatgaaatccagcgcagggcaacctgctgaaagcgggtcgtatcgacgaatcaacgcatctaactctccggcggtaagcggctgggcaatcggcagataaaactccatttcaacctgtttttcacgctcggtcagcacgctcagactaacgcccgtctcgttaaggggaacgtgcaacacggtgtccagccagcgggtaagtacgggctcccatcgcgtttcaaaaccactcagctccagtttttcctgtacccattgggggtctatcggttgagtaaaatcaagctcttcaaacaggctgtgcaaaaatgttcccggcgatgccccgcgaggaaagtgatgcggcgtcattgccggcgcttccgccgcttcgccaacgcctgcggcgtcaatgtcgagacgaggaataagatcttgcgccacgctatgtccccgctgctgcaaaccggaataactggtgacgcgccagctatcataaagcaggcgttgcagcgttctggcgctgagttccgcgtgcgatgcagcggcaatttgccagcggtcgttatccgtattgcctggcgttcgacacacgatatcctcgtcgcatagcgcctcaatacaggcgcgaaggcctgcggcatccatcggttcgcctttttgcaggagtcgcccaagcgcgctttggtgcacatccgtctcgcctttcttatcgctacgacgccgcaccagcggcgcgacgccgaggctgcaatgccacactgcacgggtcagcgcgacataaagtaggcgcaggtcttccgccaggcgttcggcttccgccagtgctatgctctcttcggcgtgactaaggtccagcaccgcctcgtaggagtgcctgtcgtgataaaaagcctggtcctgcacgcggaaatgggtgataaaaggtaaccagaccagcgggtattccagacctttcgatttatgaatggtgacgatttgcaccagatgcttatcgctttccagacgtagttgctggctggaagcattgctatcaggttcaaggatatgttgcgccagccaacgcaccagcgcatgttcgctttccagctgcgaaccggcttcctgtaacagttcgctaatatgcagaatatccgtcagccgacgttcacctcccgccgtcgccagcaggttttcagcaatattgcgcgccgacattagcgcgcgcagcataggcatcacgccgcgtttatgccaaatctgtcggtagccatcaaactcttcaacaaccgcatcccacgcattttcatcattgttaagcgtttcgatatccagcgcggtaaggcccatcattgatgtcgccagagcgctacgcagcgtattctcacgttcgggcgccatcaccgcctgcaacacccacagcatttcctgcgcttcgagcgtttcgaatacgctgtcgcggttagaaagatagacggaggggatcgccagtaaggtcagcgcatcccgtatcagcgcggcttcccgcctgctgcgcaccagcacgctaatatccgaggcgcgaacgggccgcgacgaatcgccgttcgtcagcagcgcgtcgcccgtttgcccggcacgcagccagtcgcgaatttgcgtggcgcacacctgcgccatataactttgataatcgcccgaaccgcagctttccccctccattagccacagggtcatcgccggttgaggcgcgtcattcactttaaattgcagcgactggtttctgggcgcaaactttaccggactgaagggaatatcgcggaacataaaggcgtcattcatctgactgaacagcttgttaacgctattcaccatccccggcgcggagcgccagttagtgtcaagggtatagtgcgcgctcacttcgctgcgagccttcatgtaggtaaagatatccgcgccacgaaacgcataaatcgcctgtttaggatcgccaatcagcaatagcgccgtatcgggttgatgtcgccagatacggcgaaaaatacggtactgttgtgggtcggtatcctgaaattcatcgatcatcgccaccggaaaacgggtacgaatcgccgcagccagcgcctcgccgctttcactacgcagcgcggtatctaaacggctgagcatatcgtcaaaccccagctcgccgcgccgtcgtttttcctgagccaccgtttcacggatctctgagagcgctcgggtaagaaccagatctttaatcgatagcggttcgcccaacaggttatcaatggcgacaaacaatgggtgctggggcgtcacgcccccagctttggtgcgctcagctaaaaaacgctgtgaaaattttcccaacgcctcgggtaattgataatttttggtctcttcttgcgcccacgcggtgatcttttcgatccatttcgcctgattgccgcggttgaattttctgcgatcgatgccggatgattcgatcagcgcgtccagctcgctaaccgcctcacaccactgctgcttcacctggttgatgcgcgccaggatctgttcatggcgcgatgccagcgtctcctcctgcgatggcggcgctttaatgaccggcgcttcgccctgcagataacgatcgatatcttttaagagcgccttcggccccttccacacgtcaaacaccacctgcgcgatgtcgcgcggcagcggatagcaatgacgccgccagaaatcggcgcaggcctgataacgcaacaaagattcgtcttcaataagctgttgctcaaacaacataccggattcgaaagcgttcaggctgagcatacgctggcaaaaaccgtggatggtaaaaaccgcggcctcgtccatttgtcgttctgccagtaataaccactgcgcggcctgctttttgtcgctaatttcttccagcaagcgggcatacagcggattatccgtgctttcccgcagacaggcgatgcgcaactcatggatattactgcggattcgcccacgcagctcttcagtggcggcctccgtaaaggttaccaccagcagttcttcaacggtcaacggacggggaaatgcggcgctgccgcctaaaccgagcagtagccgcagatacagcgccgcgatagtaaacgttttgcctgtgcccgctgatgcttcaatcaaacgctcgcctgtaaggggcaagcgcagaggatcaagagtctcggcgacatcattcattcttttcgctcattagaggtaacgtttgctgcaaagcgctgacgttatcccacactttccagcctgtcggatgcacgtattctgcttttccattctggctaccggcaatctgtgacaatattgccataccttgtggttccaccaccgcctggtggaagaaatcggcaagcttttgtggcgtcagcaattttatctgagcgatgattttatcacgcgagtcaaagcgcatattaccccgatcgaaatccttgcttaaacgggatgcttcttcgcccaacgtttgcggcgcctggcgcatttgcgtaatgatcgcctgctgaatttgggcgaactcttccggcttcatcgccctcagcttcgcctcggcgtcagggaaaaatgcctgatagcgttgccacaggtaagagggctgtttatcgttgctctgtagcaggaatcccattccccactgacggccaacgctcatcggaaaggcgaaaacagcgtatcccagttgctcttcggttcgtagctgattgtaaaaccacggttgaacaatctgacctaacatcgcgctgtaggcggcgctgacgtactcgtcgtagccgaccgggacaaagaccgcggctaacgcggagtcggtgctactgcccgctttttcaaatattacggactgctttttctcaaccaccacgtctttgttacgacaccacgccgatccgttcgccgcgagctgtttttggacatcttgcgccagagaggtcgcctgggcttcgctcatatttcctataaccagaaattccggacgagcgcccgtttttaacgcattacgataggccatcacctcttttaacgtaatggacggcagcaaagcgcgacgttcatcacgggaaaaataaggcacctgcgaaatcatctgcaccggcataatcgcctgttcgtaggcttttcccttctccgcagaatccatcatctgcgtataccaggatttcgcctgcgccagctgttcttccgtggcgtcgtagctaaaatatccttccagcagcgccaggaaaagctgcggcaaacgctgggtataaccgttcgcagtgaccatcagaccattgttggcgttagtggaaaagctaatgccgcccactgccgcctggttgctgagctgatctagcgccattcccgccagataatcattaagggcgaacagtacctgattgcgggcgctgtccatcgcctgcgggttacgcaataccacactcacgtcagcttttggctcgctggcgaaataacgactcggcgcataaaccacgcgcaaatccgctttatcgacaatcagttctggccgcacgtagtttttgtcattcttaataagcgtaaaatcatcaggaatataggggtttaactccggcagcgacaacgcaatgccctgtgctttttgctgccagtttttaaacgtctgttcgctaatcttatcgacctgataaggcgcatccacaaaatacgcaatcttattatggggttcctggggactgatgtaccagatgcgcgcattctgcggcgtcatcatcgccaggcgatttttgatagcggcaggatcgtaacgatcggcgatattcgccgcatccagcgtatgcgctaccgggacgcggatcatagtgtccgccagccactcgacatagtccatatcgcgggtaatcgacggatagcggaagtcgagatccagcacatgcgccagctcgtcaaagtaacgtttatctatccctttttcacgtaacgtattgagatagctaaagatagctgcgacgacttcatcacgattggccaaacctttatcagtcagcgttgccgaaatggcaaatacgccgctgttaccattaacaatcggatcagaatccgcgctaataccttcgaccagtccttgtttttgcagccagtcagagagcgtccccgggctacgattgccaatcagataagagaccagttcatcggtcttgctacggaactgcgcgctattgttatcaatacgaaactccacgcgcagcactttacgcggtagcgccggcacgtaatgaataatgatgcccttctgcgcctcggtgatgacaggtacggtaatttccggttttttaatctgtttattcggcacgcgaccataggttgcggcggcaatactcgccagttccggcaagggtttattactgtaaatcaccgccttcatcagattagatgaatagtatttttcatgaaaagcgatcaacgcctgttgcaccggattgcccggcttatcgcttagcgtttccagattgccgcctgaaaagtgcgagcctggatgcgccgggttaatggtttcggcgcttacctgcgccatacgcataccgtcacgggtgcgcgccatcgtcagctcggcattcactgcgtttcgttcgcgttcggcatactttttattgagcaatggcgcggcaatggcgtcggccaagcgatctacggcacctggaagcgcgtcgttttcaacctccaggtagaaggctgttcgataaggtgcggtgctggcgttgtggctaccgccatgtcttttaaggtattcggcaaggctatccgcctgcggatatttttttgaccccatcaggcacatatgctcaagataatgagcaagcccctgatgagcctcaggatcttcaagcgatacaacgggcaccactaacgcagaaagagactttacagcctgcggatcggataccagcaacaccaccatgtcattatcaagacgtatcgcctgatactgccgggtatctttatcgcttttacggatagtttcttgcagcggttgccaaccgatatccgcctgaactgcaggcccccagagggcgaccaataacaataacgctttgaaccaggtgctgcggggcattcacggacctcatcattaactttcattcccactcatctgtatggtcacgtaaaccatcgacctgagcggaacgggatattattgtgctgaaccaggcagcatttttttatcagtaatcagtccgtgacgaagagcgcatcatagtcgaagccttttaatggcgcgattttcatacaatcaacgagactgattaaaacgaaacagcggtaacaggtaatgccgtgactgcgcaatgatagcctgcaacgtttccgattccagctgacgccaaagacgttgataccagatatcttcgccttcgccgctcaccatcatgttgccttcataagcctgtagaaactttgtcctggccttctgtaaagtatcatcgtcgtctaacatgacatcattttcagcgtcataacaggcttttatccatgcgccgccgctttccggcagtaccaatagcggagaagacatgccttcccggtagccttcaatcagttgcgccaggtaagccattgcctgcgttttatcaagaggcggaaatcgccattctccctctttgcgcaaaaacaggcgactttcgccactaccgccgctggcacaatagacaaggtgttccagccaaagttgcacaccttgcgccacgctgattaaagcgggacgccagcgcaataatccatcctcctgtacctgcggtagccagccggttagctgaactccattgcaaagcagatccacttccaggctttggctcggcttacggcaagcgataacccggcttgccagttgctgcatctcctgacactgcgcatcccagaatatttcgccaaacgcgccgtaaggcagctctcccgcagcccgaaaacggcggaacaagcgttcggcatcgtcctcttcaaccaacgtattgagcaactgttggttaagttgatatcgcgtcaatccctctaattcaaacggttcagcatcaggaatctcactctcttccgagcggaaattaacctgaagccgcatctgaaaaaatgcgcgtaccggatgggcccaaaaacgctgcagactttccagagtcaatgtttccggcatcgtaaaaggaagcggctgcacaaagtcagaatgcgcttttcccgactgactcgccgcgggcaaccactctctggcataactttgctgttcgccgggttggtaattttgcgcatcaaaaggcatacgggtatgcagacgcgtaatatgcgctttgactcgtgcttcgctctcatcacaggtcagcgtttcgtcgcccggcaaatagtggctttgcccgatgtaatccaccaattcttgcaccagtacagagggaaagcgttcgctattatcctggatggagcgaccgatgtagctgatatacagcgtctgctgcgccgagattaacgcttccagaaacaggtagcggtcatcgtcgcgacggctacgatccccgcgcatgggtttttggctcatcaggtcaaagcccaacggcgcaagctggcgcgggtatacgccgtcgttcattcccagcaggcaaacgactctgaacggaatggaacgcatcggcatcagcgtacaaatattgatggggcccgccaggaagcgctggctaatacgttcctgatccagacgctgcgccagctcatcccgcagtagcgaaatcggtaccgcgtcgccatattccgccgcgacgccttcggcgataatggcctgccactgctgttcaatcaatgtcattgccgcttccgtgtccgcatcgggcaggaagaaatcattgagcatgtcgcgacaaacgggcaaccactcttccagaggtcgctcctgcgccagaccgcgccgccagatattaagctgcatcagcagcgaagccagatgcccgaccagctcagcaatcagaccgctggattcgtcataaggcagaaccgactgccactcgccctgggcgctttccatcgcataccccagcagcatacgcgtcaggccaaattgccatgtatgctgccccgtggcaggaagttccagctcgcgcacgttgtcatcgtcaatcccccagcgaatgcctgactcattgacccacaagcgcaaataacgcagcccttcttcgttgatcgtaaagcgggcagccaataccggtacgtctaacaacgccagaacatcctcggagacgaagcggctgtccggtaacgaaagcagactgataaatgcctgtaacaccggatgtgactgacgcgcccgccgatcggaaatagcataaggcagatagcgctccgttggcgcgctaccaaataccgcctggataaacgggctatagctgtcaatatcagccaccataacgataatgtcgcgcggcgttagcgtcggatcggcttccagcatcgccagcaggcgatcgtgcagtatttccacctcgcgctgcgggctgtgacaaacgtgaaaagagaggctgttatcctcgggatcgagcagacgcttattgtcgctgcgcgaatactcctcaagatttacgcccgccaccgcatggctttccagttcaaggatatccgcctgaatccgatgcaaaagattatctggcgtaatatcaacaaacgcatccagctcctggctgttttccagttcagatagcaggtagatataatcccgtcccagttttccccatgaggccagtagcggattaccgatatcctgttcaccgtcgctgttaaataaggcttccggattctgattttcacggaacaacggtaaatgacggtcttcaaaactgtgacgacgctggcgagccatgagttttgccagccaggctgggtcttttatatccccccagtaataccgacacggattagtaaaaaggagatggatttcaatatgtttacccagcgcctgcaatgctttgagatacactggcggtaacgcggaaatgccgcaaataaaaacgcgggacggcaaccctggcgggcaggcggtcgcgctttccagcgtttgaataaagcgttggtagagattggcgcgatgccagcgcggctgccccagcgcggcggtatattccaccaatgctttccacagcggcgcctgccagttttgcgcctctcccagaccttccacggtttttcccgcctcccactgcgtaagccagtcaggccgataaaccagatactgatcgaacaggtcggcggcgcgcgcggaaagctgaaagagtttgcgtttatcggtgtcgtcggtcagataatggcgcagcagtacaaactcatccttatccagcaactgcggcagcaaggtcatcagtttccagctcatgctttgtttgctgaaagcgctttctttggggatatctggcaacacgcggacaaacatctcccagataaaactcgccggtaacggaaaagcgatattcgccgcaataccaaacttttgtgaaagggtcatctgcagccactgcgccatacccgtgctttgtaccagaatcatttctggttcaaagggatcatccagccgctcgcgttcgacgatgaactccatcaacgcttccagcacatccagacgattggagtggtagacccttaacataattactcctgacgattaacgatttggacaatgcaagcgcgtcatctgcccctgcctgccagagggtgaaaccatcgtgacgctgatgctgacacatcccgattgcgttgtctgcatccggttggcattccagccgtcagcaggcgaaaatggatacagcgccgtttgctgccacgcctgccgccagatctggagatactggtgtcgtaatgcaaaagtgtgcattaatacccgctgatagcctgacagcgcggtgacgatcattaccattagaaccatcgccactaaaacttccgggaggctaaacccgcgttgaaaattcaggggatgcgacataacgccacctcttttaacggacaaaaatcactccagccgtggggagaaaagacaatgcttccctgaatgacgttgcccaaacgccataacgtcatgccatcatcttgcgccgccatcaccacttcatcccccgataatctccgcaaacagaccctcgctcctgaagaggaatagcgccgacattccatttcggttacgcctgaccatagctgccctcgcccccattccagcgccgactgtacgagcgcctggcgttgtatcgccatgctctgcgtcgtcacgcgggcggcatagctggcctgctgctgatttacgccttgcagtagcagactgcccagaatcagtattaaaagcgccagtattagcgaagaagcgccacgttcccgattcacagattaaatcccgttacgctatattgcgcgtcaataaccgtctgaggctcggctttgctggcgccacgcagatgcagcatgagcactggcgagaatcccgttatatcccggcgctcaacgttaaacgccgtgatgagtaccgtattgggatcggtcattttttcccatcccttaccctggcaagatgttgctccgcgtaatgtctccagaacgttatccttcatacggaacccggtctggtcggcctctttcgccggtatggtatcccagaccccgttattattcccgtcccactgaacgatgacgcattgcccctgttcggcaagatgtagcccttcgccgatacagtggccatgacagtaacccgcacgttgaagatgcttcgctacggtataggttcgctgccagatttcatcttccagcgataactgtcgcgtgttgtgccagatctcacgctgtaacgccggtaaaaatcgtgcggacccaagcagtaaaatggaacctatcgccatcgccagcacaacctccagtagcgagaacccccgcgtggttattgacacgtggcggcctcgttacgctcacatagcctgattcgcccccaggaggagacgaccagacgccactctccggcagcgtttttcagcacgatgtgccctgcccatgccgtattgcgcaggccaaagaaggctaacgacggcgtgatatcggcaaggacgacatcacgccagtcgggcgtaaacacaaagggggaagatggcgtacacgatgtttgcgtagcaacagagctgacaaagcaccatgaaccgccttcgctgaccacgcgaagaatgtgatcgcggttatgccagtgagcgtcctcacgaagttgcagcaggtaatcccgcacctgacatgcggtttgccacaggcgctgttgctgctgccagcgttgccagccataaagtcctgtggcgctgagaatgataatgagcgacatcgcgaccaccgtttcaatgagcgtatagccctgttgttttttcatgtcggcagtatggcgggcggaagaaaaataacgagcgccaaatacagattgttcgacgcgttacggaaaaaagttcatgtcttgcagcgcgttgcaaaatttcgggaatccgcgccgaagattgagacaaagggtaaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattccgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaaccgacgcgcgatggcgtcggttatggcaggatcgtcagcgcttagatagcgaccggcgctttaataccggggtgcggatcatagccttcaatttcgaaatcatcgaaccggtagtcaaaaagcgaatcgggtttacgcttaatgaccaatttcggcagcgcgcgcggttcacggcttaattgcaggtgcgtctgctccatatggttgctgtacaggtgcgtgtcgccgccggtccagacaaaatcgccgacgtccaggtcgcactgttgcgccatcatatgcaccagtaacgcgtagctggcaatgttgaacggcagaccgaggaacacatcgcaggagcgctgataaagctgacaggagagttttccatctgcgacataaaactggaaaaaggcgtgacacggcgccagcgccatcttatccagctcgccgacgttccacgcagaaacgataatacgacgagagtccgggtcgtttttaagctggctcaagaccgtggcgatctgatcgatatggcggccatccggtgttggccatgcacgccactgcttaccataaaccgggcctaaatcgccgttctcatcggcccattcgtcccagatggtgacattattttcgtgtaggtaagcgatgttggtatcgccctgcaaaaaccatagcagttcgtgaataattgaacgtaaatggcagcgtttcgtcgtcaccagaggaaagccttccagcaggttaaaacgcatctgatggccaaaaatggaaagcgtgccggtgccggtacggtcgtttttctgtgtgccttcatccagcactttttgtatcagttctaaatactgtttcatggttcctcaggaaacgtgttgctgcgggcggcggcgatatgcccaaaccatcatgatcgcgccagcgataatcatcgggatagagagaatctgccccatgctgatgtactgtacccacgcgccggtaaattgcgcgtccggctggcggaagaattcaacaatgatacgaaacgcgccatagccaatcaggaataatccggagactgcgcccatcggacgcggtttgcgaataaagagattaaggatgataaacagcaccacgccttctaatgccagctcatacaactgggaagggtggcgtggcaatacgccgtaggtatcaaaaataggctgccattgcggatgtgacggcagcagcgcaatatcttccgcgcgtgagccaggaaagagcatggcaaaccggaagtcaggatcgacgcgcccccacaattcaccgttgataaagttgcccagacgcccggcgcccaggccgaacggaattaacggcgcaataaaatcagacacctgaaagaacgagcgcttcgtgcgcctggcgaagataatcatcaccagtatcacgccgataagcccgccgtggaaggacatgccgccgtcccagacgcggaataaatagagcgggttatccagaaacagagggaagttataaaacaggacatagccaatacgtccccccaggaagacccccaggaaacctgcatagagtaaattttcaacttcgtttttggtccaaccgcttcccggacggttagcgcgacgcaccgccaaccacatcgcgaaaacgaaccccaccagatacatcaagccataccagtgaagcgcgacgggcccaattgagaaaatgaccggatcaaagtccggaaaatgcagatagctactggtcatctgtcaccacaatttcttgttatttcgctgaagagatagcgattgataagcgcgcctgcgcgttgcagacgctccaaaggtgcgaataatagcacaagggttaaaagcgagatgccgattaccgttaaaagatatgtatacgcattgtctttcatcttgcaggcgtgttgtctgcgccgtgaatccacagtcactttttcccgctccagtcgttacaaccctccgcgaatcaatccccccatcccgcggcgctccataaacgccgccacctgatgacgcacttcggtcgccatctgcgcctcaaggctgcgtctggcaagggtttgcgcgtcttcaaaatcgatatgccgcagcagatatttcacacgcgctaccgaacggccattcatcgaaagatggcgatatcccagaccgataagaatcgccacgcacatcggatcgcccgccatctcgccgcacaagcgaagatcgagaccatgtttttcggcttcctgcgcgatcatggacagtgcgcgcagcatagccggatgcaaactgtcataaatactggccacgcgggtattgttgcgatctaccgccaggatatattgcgttaaatcgttggtgccgaccgagataaagtcgatccggttagccagatgcggcagcataaataccattgatggtacttccagcataatgccgatacgcggtttcgggatcgcatagccgatcatctcctcgacctcgcgcccggcgcgttcgatcagacgccgcgcttcatcgacttcatcaatactggtgaccatcggcaacaaaatgctgaggttgccagtcgccgcattggcacgcagcatcgcgcggacctggatcaaaaagatctccggctgatccagcgtaatgcggatcccgcgccagcccagacacgggttctcctcgctgatcggcatatagggcagttgcttatccgctcccacatccagggtccgcagcgtcaccggtttatcgttaaacatttgcagcatcccttgatactgcgccacctgctcttcttccgagggaaacccgctttgcagcatgaagggaatttcagtacggtacaggccgataccgtcgatccgactgcctaacttttcctcatgctcggggctgagcccggcattcagcatcactttgatacgctcgccgcttttcagttgggcgggaagattgacgtcgtcctccgccagacgactgagttctatctcttcactaatgagccgctgatattcctgaataagcacgggttcaggatcgaccagtaattcaccgcgatagccatccaccaccaacgtacggcgatgtagcaccgaaggctggatatccgcgcccatgacggtggggataccgagcgcgcgcaccataatcgccgcatgcgagtttgccgcgccgtcgcgcaccacaacgcccgccagcctgtcctgcggcagctccgccagggtggtcgccgacagctcatccgcgaccagaataaaacgttccggccaggcgtttggcccctgaactgaatcatcaagatggaataacagccgctgccccagcgtgcgtaagtctcccgcacgttctttgaggtagttatcggttagcgccgcaaattgctcggcaaatttttcgatgatttttttaacggcccactccgcaacagcgcctttgtcgacctcggcgaagagttcgcgacgcagtctggcgtctgaaagcaggtgtgagtacagatcgaaaatggctgccgtctctttttgtgcgccggcggcaaagcgtttgctgtatcgtcggaattcgttcgccgcctcttccagcgcgccggtcaatcgttcgcgttcaagagaggtatccagcgtagacgcttcgtaaacctgttccatcagcggcatggtcgcgtcttgccagcccgttgcgatagccacgcccggcgccgcaggaagcgcgcgaattcgcgtctgccggtattgcccgaatagcgctgtgacctgcgactgtgacaggatagccgccatctgcgtagcgagcgtgacgaggaaagactcttcgctttcatcgtactggcgcaattcgcgctgctgcacgaccagcacgccgagaagttggcgacgctgaatgatcggcacaccgagaaacgcgcgaaaacgctcctcttttaccgaaggaatgtatttaaagctgggatgtttttgcgcatcggcaaggttaatgggttccgccagcctgcccaccagaccgacgatcccctcatcaaacgcaagcgcaacggttcgaccacgcggttttttcaacccccgcgtcgccatcaggtaataacagcgtcggtcatgatcggccaggtaaaccgagcaaacctctgtatccatcgcaagacagatatccgtgaccagaatattcagcgcctcgttcagacgcggcgcactggccactttttcgactatttcgcgcaggcgagtgagcataatttgcgtggcttaacctcttttacgtcgataagcaggcgcgctttgtagcttagggggattatcctgaagcgccatgacaacacttgcaaactctttcattaccctgcggtagacatcgcgtttaaatgacaccacttgtcgaaccggataccagtaacttacccagcgccagccgtcaaactccggcgtactgctggtttgcatattgatttcggcgtcggcgctcattaactgcaaaagaaaccacttttgtttctggccgatacataccggctttgtgtcccaacgcaccaaacgttttggtaacttgtaacgcaaccagttgcgagtagaagcaaggatccgcacatctttacggcttaacccaacttcttcaaacagttcccggtacatcgcctgttctgccgactcccctggatttatcccgccctgcgggaactgccaggagtgctgaccaaatcgccgggcccacatcacctgcccctgacgattacaaattacgatacctacatttgggcggtagccatcgtcatcaatcaccggactacctcaacataaaccttatatatgaacgattgtttcatactccagtgaggcggtaaaccactctgtaatagtgacacagcctaataacaattgaataactcacagtaaatagccgagttataaacagatgatgacgcccttgcgccattttattcaccttttctgtggatatagttgtgaagaagtatggaattaccacgggaaaacccagaacagtctgaattcctcatactgaaaacagtaaaaatagtgccttatattcattgtgttatagacaaatcttacatgccaccttcataaagcgtgaccagcatcacatctaagatccttatgctgatgaaagatcaaccagcgtcggttttatccacagattgtgccaataacttacgcactatttgtctgaattttcgattttcgtcgcacgtcaaggctgtaaatggaaacagtagtggtggttttacacagttatcccaactttctgtggataacatagtgtaagatcctgtttattgttagtgaccagaattggaaaacccgcttcagcgttgcgcaacacgaagaaacaacacaaaaaaggcaataaaaatcagtctattgaatataagacacagaaaaagataaactctgcccatacggtataaaaacactgctcattttttgacctaaggtaattgtcatgtccgctctttgtccgctactgactccgcctgcttcggaagcattgctgttagcccaggcgcggcagctttccggctatacgttaggcgagctggcggtgatggccggcattaccacgcctaaagatttgaagcgagacaaaggctggatcggcgtcttgctggagatctggctcggcgccagcgccgggagcaagccggagcaggatttcgccgcgttaggcgtagaactgaaaactaccccggtggatagtctgggtcgtcctctggaaacaacctttgtttgcgtggcgccgttaaccggtaacagcggcgtgacctgggagacaagtcacgtacggcataaattgaagcgcgtgctatgggtgccggtcgaaggcgatcgcagcataccgttagccgaacgccgcgtaggttcgccgctactctggagtccgagtgaagaagaggacaggcagctacgcctcgactgggaagagctgatggacatgatagtgctgggccaggtggaacgcattaccgcccgccatggcgaagtcttgcaactgcgacccaaagccgccaatgccagggcgctcaccgaggctatcggcgcgcgcggggaacctattttgacgctaccgcgtggattttatctgaaaaaaaattttacgcaggcgctgctggctcgccattttttattgcagaatccgtaacgtccattacacgcaaatgcgcctccgctatggctacgcgtcgggccgacgccggataaacgtaagcgtattgtcgccgctattttacaccgttcctggttgcgcaaattcagcctgggctttcgcccgtcactcgacgggcctataattaccgcttctttttttggcaggactttgttcgatgttatttgcatggataaccgatcctaatgcctggctggcgctcggtacgctgacgctgctggagattgtacttgggatcgacaacattatttttctttctctggtggtagcaaaacttcctacggcgcaacggaaccacgcacggcggcttgggttggcggcggcgatggttatgcgcctggcgctgctggcgtcaatcgcctgggtcactcggctgactaatccgctgtttgagcttttcggcgaagcgatttccgcccgcgatctcattctgttactgggtgggttatttttaatctggaaagccagcaaggagatccatgagtccatcgaaggcgaagaagaagggttaaaaacccgggtttcttctttcctgggcgcaatagtgcagattatgctgctggatattattttcagccttgattcagttatcacagcggttggcctctccgatcatctgtttattatgatggcggcagtcgttattgccgtgggtgtcatgatgtttgcggcacggcccatcggcgagtttgtcgatcgtcatccgtcggtaaaaatgctggcgctctcctttctgatcctggttggctttaccctgattctggaaagtttcgacgttcacgttccgaaagggtatatctatttcgccatgttcttctctatcgcagtagagagcctgaacctgttgcgtaataaaaagaatccgctgtaatcctgtctcgctcccccgccgggggagcgaatactcactttatttcctttcttctcacagattaagattttgctgcttccgacatgcagagctgcgcgttattactagactattatcagacatatgattaacagactattatcagatgcaggctacgtgaggaaaaacggatgaaaaagtgggcagttgtaatttccgcagtagggttggcttttgcggtatccggatgcagcagcgattatgtaatggcgacgaaagatggtcgtatgatcctgaccgatggaaaaccgcaagttgacgatgataccggtctggtcagctataccgatacacagggaaacgagatgcaaatcaaccgtgacgaagtgtctcaaatcatcgaacgttaagcggtggcctgtgatcgaggtcagcgttctgcaagccttcaggctgcgtcccgtaacggtgcgtggcgaccacgcccggtaacaattacgccgtgcagcctgcaattttactttcccttttgccttccctctgccatttttattgtcctttgtcgggaatttctgacttcataataaaaaggaaacggctatgcactatcaccgtataccccacagctcgctcgaagtaagtacgctagggctgggcacaatgacatttggtgaacaaaacagcgaagccgacgctcacgcacagctcgactataccatcgcaaatggcattaaccttatcgacgccgccgagatgtatccggtaccgccgcgcccggaaacacaagggctgacggagtcctatatcggtaactggctcgccaaacgcggcaaccgtgaaaaactgatcatcgccagcaaagttagcggaccggcacgtaataatgatcaaggcatccggcctcatcaggcgctggatcgtaaaaatattcgcgaagcgctacacgacagtttgacccggttgcagaccgactatctggatttgtatcaggtgcactggccgcagcgccccactaactgcttcggtaaactcggctataactgggcggactccatgccagtagtaagtctgctggagacgttagacgcgctaagtgagtttcagcgagcgggtaagattcgttatattggcgtttcaaatgagacagcgtttggcgttatgcgctatctgcatctggcggaaaaacatgacctgccgcgtattgtcactatccagaacccctatagcctgttaaaccgcagctacgaggtcggactggcggaagtcagccagtatgaaggtgttgaattgctcgcctattcctgtctggcgtttggcacattaaccggtaaatacctgaacggggccaaacccgcaggcgcgcggaataccttgttcagccgcttcacacgttacagcggcgaacaggcacaaaaagccgttgccgcctacgtcgatatcgcgaagcgtcacaatcttgatccggcgcagatggcgctggcctttgttcgccgccagccgtttgtcgccagtacgttactgggcgcaaccacgatggcgcagctcaagacgaatgtggaaagtctgcatctgacgttaagcgaagaggtcctggcggagatagaggcggtgcatcaggtttatacctacccggcgccgtgatggtcagtgcccggtggcgctacgcttccgggcttacagagacaatgtaagccggataacgcgcactcgccgcccggcatattcactcagtatgatgcctgccggcgctgccagatccacagcgccgcgatcgccagcgcgaacagcacgccaaagccgatacctatcgccactgccggaacgccaaccagcaccgccagcgagtacagtcccagcattaatagcatggcgctattctcgcccagattttgtacggcaatggcattcccggcaccaacgctcttcttaccgcgctcctggagcaaagcgttgagcggcaccacaaaaaagccgcccagcatacctatcaacaacaacaaggcataagcaggcagcaatgcgtgctgtaatgagaagatcgcaaccacaacgccaatcaaaatcccagcgggcatacagcgcgatacggtctccagcgtcaccagttttgccgccgcacccgcgccgaccacaatgcctaccgccaccatggcgttcaggtaagtcggcgtggcgttatccgtaatgcccagcgccaccggcacccacagcaccagcagaaaacgcagcgtcacgcctgcgccccagaatagcccggtccccaccagcgaaaaacgcgtttcaccgttacgccaaaggacaacgcaagcgcagaagaagctacgcgtcatcgccgacaaccgccaggattgtcctggacgcgccgccacaagcttcgggataaacaggttcgccgccactgcgccagcgtaggccaacgcgcaggcaaccagcgcggcgatgacatgccagtcggccaatacgccgcccgcgacggaaccgagcaaaatcgccgcaatcgtagaggcttccatcaggccattggctttcaccagcttatcgcccgtcgtcagttcgcccagaataccgtatttcgccggagaataagccgccgcgccaatcccgaccaacgtataaccgacaaaaggatttacgccgaggcagatacctgccgctcccgccagtttaagaccattggcgaccatcatcacccggcctttggcaaagctgtccgctatctggccgacaaacggcgcaaaaagaatgtaagcgcccacaaacaccatttgcaaaacaggctggctccagtccgggtaaaactgagctttcagcagtgccagcgtcgcgaacagcagcgcattatcgccaaaagccgagagaaactgcgcgacaattaccgacagcatccctttcgaccagatggaggtgttagtacgtactgactcactcatgatgttgttccggcgcatccacccaacttttcagcgtcacaaaatcgggtttcccgctgccaagcaagggaagctgtttcagataacggatatcacgcgggacggcaagttccggaataccgtgttcacgggcatagtgctgtaacttttctcgggtgagttcgctgtcagtcgtaaacagtaccagcgcttcacctttgctggcatcgcttttaatggcggtagcgtgcattttctccgccgaaacgccaagcgccagttgctcgaccatctccagcgagaccatttcgccagcaattttcgcaaagcgtttcgcgcgcccctgaatctgcacaaaaccattttcatcgaagcgtacaatatcgcccgtgtcgtaccacccgcgctcggtttcgcctctggcgttttccgccgacggcacctccagcacgcccggtttttccacgcgcagatagccattcatgatattcggccctttcagctgtagccgaccgccgttttcaataccgggcaccgccagcagacgcgcgtccatgccaggcagaatgcggccaacagtgccaggcttagccgccatcggcacgttaatcgagactactggcgcgcattccgttaccccgtagccctcaagaatgcgcagaccgaatttatcctgccacagttgcttggtgctctcctgaagtttttccgcaccggccaccacatagcgcaggcgataaaaatcatacggattggcaaagcgcgcatagttgccgaggaaggttgatgtaccaaacagcacggtacagttacggtcatagaccagttccggcacaatgcggtagtgcagcggacttggataaagaaacacttccgcgccggtcaacaacggcgtaaacaggcccaccgtcaaaccgaacgagtgaaagagcggcagcgccgacataaaacgatcattggcggtgaaatccgcaatcgtttttatctgctcgacgttcgccagaatacttttatggctgtgcaccacccctttcgggtgcccttccgagccggaggtaaaaagaataatcgccgcgtcttccggctgctgttttacctgcgccagtcgcggcgccaggaggtgggcaaaaatccacagcttgtcggcgggtgtgacgtccgcttttaaatcttccaggtaaacccagcgaacctgcgttagctgctccggcaggtgccacaatttacctttatcgaggaactggcgggaggtaaaaatcgttttaatttccgccgcggtaatcgcgctggtcagcccttttacccccgccgtgtagttcatcatggccggaatgcggcgacgagaaaccgcgccgaaaatcaccgccgcgctgatggcggcattcggcagcattaaaccgattttctcgccctcaacgctgtacttttccagaatccggccaacaaaaagcgtcttggtcagtaacttacgatacgtatccggcgtaaagttaatgtcctcaatacagtttttacccgcgccgtaacgatattgcgccgccagcaacgattcgtataacgtctcgcgcgggcgcactgccatacgcgcttccatcatgatctggtgcagcatctcacccgctatcttacgtctgtcgcgcgcgcgcggcgcttccggcatcggtatttgcgtcggcggtaaaatatgaagctgaatgcgggggaataagcgccgtttaaccagacctttcaggcgactgaaaggggtaagctccgcgccgtcaatgcggagcggaatgacggttgcgcccgattttgccgccacaaagcctgcgccgtcataaattttcatcagcgagccggtcacggaaatccgcccttccgggaaaatcaccactggacgcccctgctccaccagacgcaccaggtgtttaatggacatgggtttagtgggatcgagcggtacaaaatcgatcagcggcgttaaccagcgcatataccattgctggctgatggaggtatataccgcaaagacaggccgtaccggcaaaaacagcgccagtagcataccatcgataaatgaaacgtgattgggggcaattaagacccggttcccctgtagcgcccggacatcgccagtgacgcgcacacgataaagcacgcgaaacaggttacggaaaaatccaaacagcatttcaactccctttggccgacaattcgctaaaacatgaattgtggcagattacacgagttgcgtaacaggagcgatagcaaaataggttcgaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaaacctgcgcatccgcgcaggttggtgcaagagacaggtacgaagagcgtaccgaataatctcaccaatcaatacctctgggatcttgattgtgggcttcgcgcgtctgcatcgccagtccgaaaacgcaaaggaataaacggaaatgcaacgagttgtgtaaattatccgttactgttacaggttcaggcgaaacaaaaaaaacctgcgcatctctacgcaggttggtgtaattcgtgtgatcaacaatgacgttgattccacctatcaatacctctgggatcaccactctatcaacctgactcgctggcctgccagcagacaatcgcaacagcgcttcgcaaactgtaacgaaagatttgtattgtcactttacagacgcatttctcccgtgcaggtcacatttgtccgacacggcggggcaagaggcttgaacagacgttcattttccgtaaaactggcgtaatgtaagcgtttacccactataggtattatcatggcgaccataaaagatgtagcccgactggccggtgtttcagtcgccaccgtttctcgcgttattaacgattcgccaaaagccagcgaagcgtcccggctggcggtgaccagcgcaatggagtccctgagctatcaccctaacgccaacgcgcgcgcgctggcacagcaggcaacggaaaccctcggtctggtggtcggcgacgtttccgatccttttttcggcgcgatggtgaaagccgttgaacaggtggcgtatcacaccggcaattttttactgattggcaacgggtatcataacgaacaaaaagagcgtcaggctattgaacagttgattcgtcatcgttgcgcagcgttagtggtacacgccaaaatgattccggatgcggacctggcctcattaatgaagcaaatccccggcatggtgctgattaaccgcattttaccggggttagaacatcgctgtgtcgcgctggatgaccgttacggggcatggctggcgacccggcatctgatccagcaaggtcatacgcgtattgggtatatctgttccaatcacactatctctgatgccgaagatcgcctgaggggctattacgatgcgctggcggaaagccatatcccggctaacgatcggctggtgacgttcggcgaaccggatgaaagcggcggcgagcaggcgatgactgagttattaggtcgcggcagacattttaccgcggtggcctgctataacgactcgatggcggccggcgcgatgggagtattaaatgataatggcgtgggggtgccgggcgaagtatcgctcatcggttttgatgatgtactggtctcacgctatgtgcgtccccgactgaccaccattcggtatccgatcgtcaccatggcgacacaggcggcggagctggccttagcgctggcagggaaatgccctacgccagaagtaactcatgtatttagtccgacactggtacgccgacattcggtgtccacgccgacggataccgggcacctgtcgacaaccgattaatcagggtagcatgatggcgacaatgctggatgtttcccgccatgcgggcgtatcaaaggccaccgtctcacgagtgctgaatgggacggggcaggtaaaagaaagcacgcgccagaaagtgtttacggcgatgcaggctctggactatcgccccaacctgctggcacgctcgctggcaaatcgcaccagcaacagcatcggtctggtcgtctctacgtttgacggcttctattttggcagtttgttgcgccgggcgtcgcgccaggcggagtttcataacaagcagttgatcgtcaccgatggtcacgatacgccggaacgagagcagaaagccgtacaaatgttggccgacagacagtgcgacgctattattctttacactcgctatatggatgagccgacgattttgtcgttgattgacgccacggaaatgccgctggtgattattaatcgcaacatcactcaggcccacgatcgcgctattttcttcgagcaggagacggcggcattccaggcggtggaatacctgattacgcagggccatcgcgatatcgcctgtattacgctgcctgttcatactcccaccggcacatcacgcgtagcgggttatcgaaaggcgctggaaaaatatggcattccctggcaaccggcaaaagtgaaatacggcgattacacgctgacgcgcggctatgacgcctgccgggaattactggaggaaggcgtcacgtttagcgcgctattcgcctgtaatgatgacacggcgctgggcgcggcaaaagcgctgcgccaggccggattacgcatcccgcaggatgtgtcgctgtttggttttgacgatgcgccgggcgcaacctggcttgagccggggctttcaacagtctatttacccatcgaggatatgatagccaccgcaattgatcaggccgttcgtctggcgaacagcgagccggtcgccccgatcccgccctttaccggcacgctgattctgcgcgagtccgtcgccgcgggcccgttttttcaacgtccggtctaatgatgcgcttcagagcatctccagcgctaacagctcttcaatggtttgacgacggcggatcagccgcgcctgtccattgtcaaacagtacttccggcaggagcgggcggctgttgtaattcgatgacatagacgcgccgtacgcgccggtatcgtgcaatacgaggtaatcgccggggatgaccgcaggtaaggcgcgtgtttcaaccattcccccttcctgctgcgtaaaaacatcgcctgattcgcatagcggcccggcgaccaccgtctcgacccacgggccattttcaagcgcgcgaccatccgccgccagcgccgaaatacggtgatagctaccgtacatcgccgggcgcatcagatcgttaaaaccagcgtcgaccagcacgaaatggcggcttcccatctgttttacgctacgcacctgcgttaccagcacgcccgattgcgccaccagataacgtccgggttcgatctcaagtttgaccgcatgtcccagatggcgggcgatttgctcgcgcgccgcgttccacagaccatagtaatggcgcgtatcaacgggctcttctccctcatgataaggtatcgagagtccgccgcctgccgaaatcgcctccacatcctgaccacattccagcacctggcgtaccatcgcgccgcaaacctgctccagatggccataatcgacgccggaaccaatgtgcatatggataccgacaagtttcagtcggtatttctgcattaccgccagcgccgccggaagatcgctatgccagatgccgtgtttgctgttttcgcccccggtgttggttttctggctgtggccgtgaccaaagccaggattcacgcgcaaccagacgcgatgcccaggcgaaacctgaccaagctgcgtcagcatatctaccgagccggcattgaccggaatatgcagttcactgacgcgcgccagcgtggcggcgtcaatcacatcggcggtaaaaacgatatcatcagggcacgtttgcggatcgtagcccgccgccagcgcacgttcgatctcccccaatgaaacagaatccaccttgacaccctgcgcgcgcattaagcgcaggatatgaatgttcgaacaggctttttgcgcaaaacgcacgacgtcaaactgctgcagggcggctatctgacggcgaataatgtgcgcgtcatagacccagaccggacagccgaattcagcaggcaatctgagcaaattttcagcgttaaggtcagtttcagcgtgataatgcggcaatgacataacaaactccggaacaggctttttaacgattacgccataccttagaaagaataaaaaatatcgttttattgtcagtctatgcaaaaatgatatgggataaatgattcagggaaacgtatggctgccgttaatttacgtcacattgaaatttttcatgccgtaatgaccgccggaaatctcaccgaagcggcgcggctgctgcatacctcgcagcctaccgtcagtcgcgagctggcgcgttttgagaaagtgctgggattaacgctgtttgagcgcacacgcgggcgcttacatccgacggtgcaagggctacgcctgttcgaagaggtacaacgctcctggtatgggttggatcgcatcgtcagcgcggcggaaagtctgcgcgagttccgtcagggcgaactctctatcgcctgcctgccggtcttttcacaatcctttttgccgccgctactaccgccttttttggcgcgttatccggatgtcagcctgaatattgtgccgcaggagtcgccgttgctggaagagtggctctccgctcagcgccacgacttagggctgacggagacgcttcatgccccggcaggaacaacccgcaccgagttactaacgctgaatgaagtgtgcgtactgccctgcgaccatccgcttgccgccaaaacggtactgacgccagacgattttcagggggaaaactttatcagcctctcccgcctggacagctatcgacagttgttggatacgttatttgccgaacatcaggtgaagcgcagaatggtggtggaaacgcatagcgcggcctccgtctgcgcgatggtgcgcgccggggcgggcgtttcgatcgttaacccgctgaccgcgctggactatgccgccagcggcgtcaccgtccgccgcttcagcattgacgtgccctttaccgtcagcctgattcgcccgctacaccgccccgcctccgcgctggttgacgccttcagtaagcatttacaaacgcatctttcgcgcctggtcgaaccgctggaggttattctggggccgatgacgaaagcataaagctcacggcatctgcggcatgaattgccgtggtatcgaaaaccggtagcgcgctttgcgtctggggaacaagcaaacctatttcagtacagccaaaaataacgccctgcgcgccttgcgcagccagttgttcgataacctgtaaataatagtggcgcgacgcgtcagtgaatatcccctgacagagctcgtcaaaaatcacctgattgatacgcgcccgatcgtccgcctccggcacgatggtctcaatcgcaaattgctgttccagccgcccgcgataaaaatcctgctccatcgtatagcgagtccctaatagcgccacgcgatgcaacccctgacgggcgatggctcgcccggtagcatccgcgatgtgtaggaaaggcagagaacaacgagattcaataatgtgcgcgattttatgcatggtgttggtacacagcacaataccttctgcgcccgcctgctgtaacccctgcgcggcctgcgccaggatatcgcccgctttatcccattcgccgcggcgttgacatacttcaatatcgtggaaatctacgctatgcagcagtaagctcgccgagtgcaggcctcccagctgctgtttaatgccttcattgattaaacggtaataagggatagtcgattcccagctcatcccccccaacagcccgatcgttttcactgcgctctcctttttgtaaagcattatggcagtgaaacaaacttacacatccgtttccagtctatttttcatcatgccggataacaggcgtcatccggcatgggaggggggattacacgccaatatttcttagcttctcgcccgccattagcttgcgttcgatgtgctccagggtgacatttttggtttccggaatcagccagaaagtgatgccgataaaagcgatattcagcgcggtgtagagccagaatgtacctgccgcgccaatgctgtccaacagtgtcaggaatgtcgcgccgatgatcatgttcgatacccagtttgtcgtggttgaacaggtaatgccaaaatcacgacatttcagcggctggatttccgaacacagtatccacaccaccggagcggcgctcatcgcgtaaccggcgatacacatcatcgtcatcccaacggaaagccaggagagaccgcttgatgccgtaccgttatcaaactgcatcaggcagtagcccaacaccaatgtccctaacgccattacgctgaaaccgatttttaacgccggtttacgcccggccttatcgaccgtaaagacggcgataaaagtcgcgaacataaaggtcagtccgaccaccagcgtagcgatcatttgctgttccgtggtggtaaagccggccattttaaaaatgcgcggcgcatagtacataatgatgttcatgccggtgaactgctgcattgcctgtagcaacataccgaggaacacggcgcggcgaacattacggttagctttaaataatgcccatccgccctgcttgagtttgaggctttcccgaatctcattcagttcatcacgggctttttccgaggtatcgcgcagcatacgcagcacctcttccgcttcgatatggcgacctttttgcgccagccagcgcggactattcggcaggaataccaccagaataatgagcaacaccgcaggcagcgccagcacgcccaacatcgcgcgccagttgccgctgtagctgaatgccgtatcggataaaaaagccagcacaatgcctaacgtcaccatcagttgatacatactgatcattttaccgcgaacattttcgctagccatttcagagagataaagcggcgcggtataggacgcaatccctactgctacgcccagtatcacgcgggcgccaatcaatacttccacgctggaagcaaacgccgaccccagcgagccgagcacgaacaaaatcgcgccagccatcaggctatacttacgccccagccgaaatgaaagccagccgttaaataatgcgccaattgccgcgccaagcatcatactgctgacgacccattcctgcagccggctggtcagtacgaaatggtcggtaataaaaggcagcgccccagcgataacgccgatatccagaccaaataacagtcccgctaccgctgcagaaaccgaaacaaacatattcatacgtcgtgtgtcgcgaagcgaacgcggcgttaaagcagagtcattaatagagaccatattttcctgccaccacagagtaagacatagcctgaaagtacgggatactcttcctcaagtgtcaggctggaaacggcataaatatggattaaatggctacgctatagcgatatgtgatggatattacactttttaaatttaacgccgttgccgggtattttttcaaaccaccaatatttcaataagttaaaccatttatcatagctattatttaacaatatatggattaagttaaacccacaatatggactatgctaatgagatcataaaaaaaccctgtacgaggacagggctttatcagttttttcggccaaagagtcgattttcccagaaacgcatttgtcagtagcggattaacgcgccagccaaccgccatctaccgctatggtatagccgttaatataatcagcggcgctggatgccaggaagactaccggccccattaaatcgcccggtagcccccaacgtccagccggaatacggtcgagaatttcggcgctacgttgtgcatcagcgcgcaattgctgggtattattcgtggacatatagcccggcgcgatggcgtttacattgatattgtgtttcgcccactcgttcgccatcagacgcgttattcccattacgccgcttttcgacgcggtataagacggaacacgaatgccgccctggaaggaaagcatagacgcgatattaataattttgccgccgttgccctgggcaataaaatattttgccgccgcctgagacataaagaacacgctcttgatgttcaggttcatgacgtcatcccagtctttttccgtgaaatcaatcgcatcttcacgacggatcaaacccgcgttattcaccagaatatcaatatgaccgtattccgccaccgcccgttccagtagcgccggaataccatcgatttgacgcagatcggctgtcaggcttaaaaaacgtcgtcccagagcggtgacgcgcgcaatagtttccgtcggttcaacaatgttaataccgacaatgtcacagcccgcttccgccagccctaacgccatcccctgtcccaatccggtatcgcaccccgtcacaaccgcgactttaccttcaagagaaaatgcattcaaaatcattgttaatccttatttttgtcatgcctgtcacacaggcgttatcaccggtcgcgactagcgcagatcttgtaccgcaacgtgatccatgtcatcgaagacctgattttctcccaccatgccccaaataaacgtataggctttggtgccaacgccggaatgtattgaccagcttggggaaataaccgcctgttcattacgcatcacaatatgacgggtttcctgaggctgccccatcatatggaaaacgcaactgtcctcttccatattgaaatagaggtaaacttccatacggcgctcatgggtatggcatggcatggtgttccatagattgccgggcgccagttcggtgagtcccatactgagctgacaggtttccagtacatccggtacgaagtatttattgatggtgcgacggttactggtgaggttatcgcctaaggtgacgggcgcaacgtcggcaggcgacacttttttcgtcggataagcggtgtgcgctggcgcgcagttgtaataaaacttcgccggtctgctcgcctcattgctgacgaagaccagctctttcgcccctttaccaatatacagagcatcacgatgaccaatgtcatggcgctgcccgtcaacgataatggcgcccgcgccgccaatattaatgacgcccagctcgcggcggtccagtaatcgggaaacgccaagctgtttacctacttctccgccgatttcaacgggatggctgacgggcataatgccgccgacaataatacggtcgatatggctgtagaccatcgtatattcatcagcgacaaaaatattttctattaaaaactcgcgtcgcagcgcctgggtgtccagcgttttagcgtgctcgctatggatactttgccttacgtccacttttccctccaatgataaatcgatcgcaacggcataaaatcaaaacactgttttgatttatttaacggcatcatagtcgcctggataaaggttttcaacaataaataaaacaacgtttcatttttatgtctggttatttttaaaactgctgtagcgatcacgatcggcgctaaaacttacgcatttgtctgattttcagacatgcgcgccagatgctgtatgcggttacccagataaaaattggagcttgttttagaacgaggtctgatgtgcgaattgaattaaaagcggtacgcgtctgcaatgcccgccgcggcaagaagttctgcgctataacgaaaaaggggggtctgtcactggctttgccctcgtgatagagggctttttatgacggaatactgaagcaggaaaagggtggctggcgtaggatcagtcgcgttcaatggttaaagcaacgccctggccgccaccgatacacagcgtcgccagaccttttcgcgcgtcgcgtttaaccatttcgtgcaccagtgaaaccagaattcgacaaccggaagcgccaatgggatgccccagcgcaatcgcgccgccattaacgtttacccgtcgctcatcccattccagcatttttcctaccgacaacgcctgggcggcaaacgcttcgttggcttcgataaggtcgacctccgtcagttgccagccggcacgctccagacagcgccgggtagcatataccggcgcaatccccattagcgcaggatcgacgccgacgctggcaaacgcgcggatgcgcgccagcaccggcagccccagcgcctgggctttcgtctcgctcatcatcatcaccgcggcggcgccatcgttgattgaagaggcattacccgccgtcaccgaacctaaactatcaaacgccggatgcagcagggctaacccctccgcactggcgtcggcccgcggttgttcatccgtatcgacaattgcggtctgcccattacgttgcgtgacgatggggacaatctcatctttaaaacgtccggtatcaatcgcggccctggctttttgttgcgaactgagcgcataagcatcctgtaactcgcggctgatgccatattcccgcgccaggttttctgccgtcacgccaatgtgataatcgttgaaggcatcccataagccatcatgtaccagactatccaccagattgtcggcatcaggcaacgcgccggtacggctgtcattgaggacatgcggcgcacggctcatattctcctgcccgcccgcaataacaatgtccgcttcgccgcactgaatagcctgcgtcgccaggtgcaacgcttttaaaccggaaccacaaacgtcattaatggtaatagcggaaacggtagtcggcagccctcctttgatggctgactggcgcgccggattctgcccggcgccagccgtcagtacctgaccgaggatgacctcatcgatagcattagcgtccacgccggtgcgctcaattaacgcttttacgaccatactccccagctcgacggcggaatgacgggccagcgttccctgaaaacagccgatgggtgtccgtaaagcccccactatcacaacctctttcattaccacctcagcgcaaaatgacaccgccatagtagagcattgttaaaattagttatcttgattgtttaaaaaaagtgagttttatcacaaaggaaatgacgctgatttgacggtggcgcagcttatttctgctgtaaatggtagcgaagccagttccccgccgttccgggcggcgtcttcttgttccacaacaaatcaatagcaatcgccctcggccagccaggaacatccagctgcgccagcggtttttccgccgcaaactcttccaccagcgcgcagggcaatacgcaccagccaaatccctgaaccgccatgctcaacagcaataaatagtttggcgctgaccaggccgggccgcgcgtaatgttggcgttagagtcaaggtaggtattcagacgcagctcgcgccaggtatgcagttgctcccattgcaggttcgtctgcgacgccaacggatgcgtggtcgccacataaacccccatccagctttgaacaagcagacgcgtcgcgccaatgtctgtgggatagttatcacgcgcttcaatcaggcctatctgggcgcgccctttttgcagcaggtcgatgacatcatcattttctccgatcaaacattcaaactcggtatgcgggaattgacgatcaaactgcgccattaactcttccagactgtcagggtgcagggtatcagagaggacgaacgtgagccttgtctccgtctcgccggataacgtcagcgccacctcatccagacggtcgctcgccgataaaatagcctgaacatagctaagcacccgttttccttcttcggtcagaacgggctggcgcgatgatcgatcaaataatgaaaatcccagatccgcctccagatgcgcaatggcggtactaatggtggactggcttttacgcaggcggcgcgccgccgcagaaaacgagccgcaagagacggcctcaacaaatgccattaacgcttcaggtgagtaacgcataacctatctactttatcgatggattttatcttttaggtatcatattaaacgataaaatagcggaaatttctttaatttgattaagagtaaggttttttcatttatgcaacatgacgccatacaacgtcgctcgctgccggagcgtattttccatgctgtctgttttgaaggtattgcgactgcgatactggcgccaacgaccgcctggctaatgcagcgctcggtgctggagatgggcggcctgacgatattgctggcaacgacggccatgatctggaatatcatttataacgctctgtttgatcgactgtggcctgcgcatcaggtgagacgaaccgccaaagtgcgcgcactccatgcgttaggatttgaaagtgggtttattgtcattggcgtgagtattgtcgcctgggtactgaatgtcagcctgctacaagcattcaccctggaaattggtttcttcctgttctttttgccgtacacgatgctgtacaactgggcatacgatgttttacgccaacgaatagtgacccgccgccaacagcgcgttagtgcatgatattgctcttttttgccgggatcgcaacgctcccggccctcctcctccacgacatccatctgcttaaaacgcccccaactgacgctatttatggtaaattgcgcttctttttgtgtgttttatagttgataaattcaaataatgtctaaaatttggtcaaaagatgagactctctggagttttgcattatacggaacggctgtaggcgcaggcactcttttccttcccatccagttgggatcggcaggcgcaatcgtgctatttattaccgcgctggtcgcctggcctctaacatactggccgcataaggcgctgtgtcagtttattctttcctcaaagacttctgcaggtgagggaattactggcgccgttactcattattacggcaagaaaatcggcagtattattaccacgctttatttcattgcgttttttgtcgtggtattaatttatgctgtggcgattaccaattccctgacagagcaattagagaagcatattcagatagatattcgcatccggatggcagttagcttcggcgtagtacttatcctgaatatgattttcttaatgggaagacatgccactcttcgcgtaatgggctttttagtctttccacttatcgcttacttcttgttcctttcgctctacttaaccggaagctggcaaccctcgttactgaccgggcagatgtctttggatagtcacacgttgcaccaggtatggatttctattccggtgatggtttttgcttttagccatacgcccattatttcgacgtttgccatcgacagacgggaaaattttggcgatcaggccatggataaatgcaaaaagatcatgaaggtcgcctacctgattatctgcctgagtgtgctgttctttgtctttagctgcctgctctccattccgccgtcatacattgaagacgcgcgcaacgaaggcgttaccatcctttccgcgctctcgatgatgcccaatgcgccggcctggctctctatttccggtattatcgttgccgtcgtggccatgtcgaaatctttcctcggcacctatttcggcgtcatcgagggcgcaaccgaaatggtaagaaccaccctacagcaggttggcgtgaaaaaaagccgggcgttcaatcgcgcgctgtctatcatgctggtttccgggattacgtttattatttgctgtattaacccgaatgccatctctatgatttatgccattagcggcccgctcattgcgatgattctgtttattatgcccacgttgtcaacgtacctgataccggcattgaaaccctaccgttcaataggtaatttcattacgttggtcgtcggtttactttgcgtatcggtgatgtttttcggctaaagtaaaagatagccgggatataactcccggctattttatataagaatccagcacctttaatattacgtccagatcttcttcacgtctggcttcatcactctgatgaacgatatgctcggtcagatgccctttaatcacctcgcgcattaagccatttaccgcgccgcgaatcgccgcgatctgttgtaacacggccgcgcattcatgcggttcatccagcattttttttagcgctatcacctgcccctgaatcttgctggttctggctttaagcttttgtttgtcccggatggtatgtgacattacaacacctcactaacattaacgaatacaaattatagcattacgatgctactggggggtagtattccatactgggggggagtagaatgacgcccacataaaacaactaagaatcattctcatgggtgaattttcgacacttcttcagcaaggaaacggctggttcttcattcccagcgccattttattaggtattttgcacgggcttgaaccagggcactccaaaaccatgatggcggcttttatcattgccattaaaggtacggttaaacaggctgtcatgctcggtctggcagcaacgctttctcataccgcgatcgtctggttaatcgcgctgggtgggatgtatcttagccgggcattcaccgcacaatcagtggaaccatggctgcagttaatttctgcgatcattattctgagcaccgcgtgctggatgttctggcggacatgacgaggcgagcagcagtggctggcgggaaaccaccatcacgaccaccatcacgaccaccattacgaccatgaccatgaccatgaccatgaccatgaccatgaccatgaccatgaccatgaccatcatggtcacatacatccggaaggcgcaacgtcaaaagcgtatcaggatgcccatgaacgcgcccatgctgccgatattcaacgccgttttgatggtcaaacagtgaataatggacagatcctgctgttcggcctgaccggagggcttatcccctgtccggctgcgatcaccgttttactgatttgtatccagcttaaagcgtttacgctgggtgccacgatggtgctgagctttagtcttggcctggcattaacgctggtgacggtaggcgttggcgcggcgataagcgttcaacaggcagcaaagcgctggagtggtttttcgacgcttgcccggcgggcgccctatttttcgagcattctgattggtctggtcggcgtgtatatgggaattcatggctataccgggatcatgcagtaaatatgtaacgcttctgctcaggccgtatcattcacttcgggtttcattccagaagcgtttttacttatcaaacggtatgaaaggccatacattcagcgtcccgcctgaattctgtattttactccactacaccacaggcaaaacataccccaccgccaccgggtttagccggtgtgtcagtgtttctggatagggtcgccggaggcgggttattgcggagcgataaacggagttcgctgcagtgatttacaaaaccgggtaccaaacagcagttcccgtaatcggttccgcattcccagcttcaccagtaaccggtatttgtcctgccagatttgcttctcctgcgtgttcagccttccacacagcgctgataaccttccccgtccacggtaaacttcctgaagcaagcgtaactgggccaggctcactccgcatgccagtatctcccggtgcatcaactggtccatatagttcatcaaccgcttcggattgttaaatatcggtggcacttccagaaagcccgtcaccggatccggagataacaaaaaggcgtccagccctcctgtcctgcgcaggcgtgcgcccccggcccactgttcatcccgccgccaccgaataagtatctccgccagttcctgctccagcagcgccgggatgccgccgtataccttcagtaccacccggtcgctgaaaaacagctcatcgctgataatcataaccgggtagtccggcagtatctgcctcagggaatagaacaaaaagagatgttcacggggacgcagacacagtatcagtatggcctccggtttccgacgtaattgctgcaacagaacaggcagcctgtatgcggtttcacagttgcagcccggcagaaatctccggaccaggtgtgccacggcgatcgtcaccggccagcagtcaccgtaaacgataatctgccgggccggtatccggttatgttctgtcatcctcatcctccctctttttcaggatctttcccgcatttctgttactgcacagccggttccacagttcatttgccatcgacctgtcaccattaccgacccggcgttttgataccggcggcggtccggctttttcacggcgcgtggacggggtgggactgtcaagaacccggataacataaatctcatagcgtcgtgctttattgggcagggtctggtgacggcagatgctgaccacccgcgatgttttgcttcgcagataggcaatcaggtagctggcccgtctggccgtgatgtgaaacgcctctgctatctggttacgctgaacccagttctgctgcaacaggcaccagtgtgccacgatgatatacaggggctcgccggcatactggcggacacttaccggaataaaacaggcatcatggttggtctgtccgggataatgaatatcgttacctgggataaggtactgcttttttgcgtgtgtattatcagggcacataaaacctctccataactgggtaaataattttccggaggtgaagaacagctcttaaatagtatttattattaatgtgggtttattcgggattagttccccgataactcagtcagctcttttatttttattatctgtcacccccgattagttataggtaacagtaacgagtattgcagcagaaaactttcctgtctttacacttccccccagggtcggggttattactgcagtatataccttcgacacattaccggtgacagttcctgtaatagtaatatcccccagtacttcttgtttatcaaaagtaatctcttttcctttatcatcttttattgaaagccggagtccattaggctgacctttgttggggccatccagactgacaagattcagagtttgcccggtatcctgtgtcagcgcacctttcccgaaggtgatggccagcgggatcgcgaattcctgtcccatagccggtcgtaaaacctgcctggcgatcactgtaaaatttgcctgtctggtctgtgaaggttcataagtcgtataaatatgcccaaagttgacctgtaatggaacaatgtcaactttacccaatccgtttctgagaattctcacattaaaaccagataaaacaaatccgttttgtctcaaagaataaggaaaaggtacaatatttaaaacattacttatccccgtaaaagctgtaactgcactactctctgaatatgcttttgtatataagaaatccagtgttatccttacttttcgctctgtagttccaacaggtagttttgtgccaaactcttttcgtaactcatttcctgactgagtgctctttatttcatcccaggagaacgaaacaacatttgaaacattttctgtttctttaacggacattctgaatccaagtcccatcgcatctagtgtctgggtaaatttactgaagtagccctgattaaataccagctgtggaaattgcgtgccatatcccattgaacatttgaaaactgcatcctgattgattgaatagataaccgaatccgggccaggtttaaaatcatcggttgtcaaatttatacttcttaaattaatattctgaccagaagtgactacacattcatttatacctggctcaaccgcatacactttagtcacacataaagaacacaacatcatcaccagcacggtcagttttgttttcagattaaaaatccattctgtcatgatgtcacccctgcgtccttaaacgcgcagttcagggcatcacaggtgtagcggttcatctgcagtccaccataatcatctatataccccacccacagcgtccgggtttctgccggcagaacagcctttaagggcaggctccccaggggcggcaccatcacgccctcgcggaaaccgctgagcctgtggctgcggtctgctcccagccacgccacagtgatgtagtacggcgtcgggtttctgagggtcagatgtcccgcattccgctcagcagtcagctttctttccggctggtcactgctgcttctgataatggctttcggacggtaaaacagtttcagctggctctgcatggccagttgcaggacgttgtcgtcttctgacttcgggggaacgccccgcacgttaaaccagaacagcgtttccctgtcctgagggagcttgtctgtcagcccgcgaacctgggtgatacggacctgggatttctgtccggcatcaatacgctgcagcggtggcagcgctatcagcgcatccgttctcaccccgtcagcgtccgtcacccaggactgcgccaggaacggcgtggttttgtcatcgttattcagcgtgatggccaccgttttctgcggtgcatccatgataatacgggtccggtcgacattgacggctgccgggctgtactggctccatgctgccgccagtgcgagtaaaatcacacggcttcttctgctgtttttcacctgttttctccgttagtcctgctctgtgacagggatatttttatctgcagggcagtaacagcggcccccgactgagtgtcaccgtttccggcagggtgagtctgcactgcacccggccatcccagggcacgttcagggtccggcggtcttccccgctgagtccggtcaggtaggccagaccgtcatccccgaccatccccgcggttctgccggtttttccggacaccaccagggcgccaaacggtggactggcgccatcagccagccggatatgaccgagcacctgctccccctggctggcgtcaatcttccggtagcccaccgcgccctccgtcagcacctggctgatgacggagctgctaacgtccacgtcctctggcagggcggccacatcaaccgaaatatcgctgcgccgatagctgctgccggcgctcaccacgcccaccccgaagcggttggtcaccccgctgttgccgttcaccggtacaccggccacgtctccggtatctatcatcatgcgaggctcattcccggccatcgactggctgaaggcggcgccgtgggcggtggcggtcaccgagccgtaccagctcaggcccaggctgcggtactgtccgggctgcagggtggcgtccgctgccgcctggccccacggcagacggctctgcacgctgccgctgaagctgctgttactgccggtgtcatagcggttatgaccggcgctgatgttccatgtggtgtccgggttatggaaatcgctgtaattcacggtctgctgcaggccgccctggttatccttctgcacgctgtagctcacctggcggctgtcgccccacgggatactgatggtggcgtagacctgattctggctgcccccgccggtgtactggttacgggcaaacgacaccgaggccgagagcccctgaagctcgccgagactgaacactttgttgaagctgagcatgtagttattgttggactgcgcattccagtaattgagccggcttaccgagagggccgcgctcatgttgagtaccggaacggactggctataagtcacggtgtagctctgtttttcatgccatgcatcgccgccgtcggtggcccgacgctgcaggtactccggcatggacagaaaatggcggtccgagaagcggtatccgacgaacgccagggtactgccggttttatcaaacgttttggcatagttgatacggtagctgtaaccggactgcttctgcccgtgcggcaaccgcgcatctgagcgggtgacgtccgcagacagagcgcccagcagccccatattctggccgatcccgagcgccgcggactggtagtcgccggtggaggcaatgaggccgccatacagcgacgtgttgttaaatgctccccaggtggcctccccgagcagaaagtcagggctggccgtgctgttgttatgcgtaccgccgtacagcggacgtccggcggccaccttatagcgaacctgtccctggcgtgccataaaggggacgctagccgtgttgacctgccaggtccggacgctgccgtcgctttcccggacgctgacatccaggttgccgctgatattctggctcaggtcgggaagctcaaaaggccccggtgacacccgggtctggtacagaatgcgaccattctggctgacggtgacctgtgcattactgttcgcaatgccgctaattttcggggcatacccctgaagagagggcggcagcatgcgctcatcgctggccaaagtgagcccagcaaagcggaaggagtcaaaaatagcggagctgaggtacgtctgtccgagcgtcagttttgagcgcagtgctggcagggcacggaacagatacgtctgcggcagataaaaatcggactgtgatgcgccctgcccactgtcaaaacggctgtactggtaatcgctccgcaaccgccaggcgccgagattaaacccggcggtgccgtagaggctgtagctggtagaggtttccccctgctgcggcatatagcggttgaccatcaggctgtaatcaagcaggccagcggtgacgccgtcgctccagcgtgaagggggcacccagtccgggtcctgataacgcatccaggcctggggaataatgaaggtcagacgctgattttcagcgctgtaccgtacctgactgtcagcggagcgcagctcaaggcattgcccgtccgggataccggtaacgggtttcaggccatgaataatcttatccttaagacccagcatggccaccatgtctgttgtcacacagatgacgaccgcatcgcgtccggcaaccggtacaaccctgactggatactgttcccgtaccggctggtcattgagccagatatcgagaatatagttaccgggcgccacatacccctcgcggctgaaggccgtgaggtccacgttagacaggttcccgctgtccagcaggctggcattgaactccgtggcctgcgacttcaggacggaaaatgtcagggtaatcagaatggcaagccgggtaattttcatggcatggcgctttcgtgttgtcgtccgtgtaacagacagcccgcaggcatggtcagatataaaagccgtccgaacccctccgtggacggcttctccctgtcgttatttaccgcgtaaaatcacaggtatttcagagtgtaggtgacagatgcggtgaagtcaccgggcgtgacgccattatccagtgctattagccgggcatagaagttgagttcgttgtttccggcctgcagttgctgagcgtcgtcctccggcatctgggtgttgggctcgataattgcggtgttgtcactcttcagtagctggacaccaacatgctgtgcgctgccgctggtggtgtaagcctttttcgcgacattggctccgccagagaaagagacggtcactttggacattttccctgcggagccagctgtgtccgggatattcggatcgaaagcacagttctgcagatgaatggtgaacggttttgagtccgtggttgcatcggcggtattcagtttacggtaagaaatctgtccaaatggaacggtgatcgcatcgtcgcccggtgcgatatcacagggggagttggtgatggtaccagtaaaggtaattttacctgagccgaacgggcctgctgttggtggatcgactgcatatacagaagcgccatacatcataccggcagccgccatggcaagtattattttattacgcatagataatatgtcctttgggtgaatgagaattattttgcaaaggctgaaaacaaatctgagggtattaatgaaagcgttcagaaaagattcgcatgaataataaacgccgggtgttaaacgaagcacctgaactttccatcgaaaaatattgatttcagctaatgcctaatcagttgtaagaaaattcttattcaaattaaaacaataaaaatagatcgatacgatcgatgattatgatcgtaatttaagaataatcatcaaagaaatacttttaaatgtaattataagcgaatgaacacctaacagacagatattctcagcggacatgaaatattttgtaatatgttatcgggaatgtatgttttgcttttccattacaatggatatttacaacacataatactaatcatatataacaatgaaattacttgtagcataaaaaactagatatagcgcaagtagaagggatttaattccaaagaattaacttaataaatcattatgaaccatcataagcggaagggataaaaaataataaatgaaatgatattcttctgtatttgtgatggacatcacaatagatataaatgcaggtaccctgatattcctgaacttcacggatgaattttaaaaacaatgccgacagcaaagaacaaactggtaatggctgtcagacataatgctgcctgctgtaatatatacagcaggctgggggatattaatgcgcggcgtcgtgctgcacggggtgcgtgggtgattcctgaactgactgagagtctacaactatgccatcctgagctgatttcagtaacagacctgcctgatagtattttccttcgttcatcaaggaaagcgctgtagtcacatccttacgggtttgctgaagaggaatgagttcctgattttcaataacactgacgcctgctagtttcagggcctctatagtcccttttttatctccttctttcattttctggtttgctttattaatagcatcatttttctggcccgcagggagataatcttcggctaccgtaatcgatgaatttatccgaatatagtggtctccttcaactggggcttttttatctgatttgacatacagattccagtcagtgctgtcatcgttcaggagtttttctgcttgcgcagccagttgttccgccttttgggtgcgaccattaaacaactcgaatcgcgacattccgatatcacgcatggcctgccaggcctgtccggatatcttgtcattattcagagtaacgttatcagtcatgtttgttgcggccataagatttcctgaaaacaggataaccatcagcgcaacgcctggcataatatggcttttcataatccatcatctccacaaagtaacattttttatcggattatcctattcagaaccggtaacccacgccaagattaaaaccattgctattaaggcttccgctgttatgggtagcatcaaaatccgctccctcataacccagagttatagcgacattactgaccggggtataagccacgccagcagaataaccatatccgaccttactatcagactcatttatcccgtgatcacgctgatgcaataatacggggcccacttgactatacagacttaactggttatttattttccatgaggggcctgcaagcagggagtaataacgggttgttacacgaccattactgctttcatcggaatagcgctggcttccatttagccaggcaaatgaggttgtcagcccccagtccggtgacatttcatagttgtttgccagccgaaccccacgcaacgtcccggcgtgattagtatgggactgggcgtatccaagtgaaaatgtactggcattatcgtctgcccataccggactggctgcagcagacagcagaacaataccggcacttccggctaatagcattttgttcatcttcttctctccggttatttttacctgatgccttactggcatgtattaagttaaaatctttccgtgataacaaactataaataaatcttttaaattatgagcactgttacgccagcaaatacctttatctccggctatcgggaggctattcacgaaaatatatccaggccagaaacagtatttaataataaataaactgaaaaataaaaactgacaaaaatagaagttcactgatatataccaaaaataatttgagttgctgaaaggcggcaagggagtgagtcccaaggagcatagataacgatgtgactggggtgagcgacaaatctgccgggagcagatttgaacgtcgcgtgcgacggcccgtcagggcgaggcctatggatgggccgagtaatccgtagccaacacataaacaacttgaagtatgaagggtatataacgggaaagaagccatatcggcctggtaaatcaacgtctgtgatttaagttgcaggaaacggctatggagaggggatgcggcagttatcgggcagtaacggcattgttcagtgagtatccaggaaacaaaaaaagaagggagcggtactcccttcgtaaccatgtcagaatacgacattttggtactcttttatttattatctggccgtaaaagttatgctgttggcagatatctccagtcaacataaaaaaataccaccagctaaaaatgtgatgcaaaccaccattaagcaggtaaccaaattgactgtgccactacaatccggaaaagagtttgaatccggggataacatctgatgcagaaattagcaccagtcttcgattcggatacccggaatgcgttcaaactcgcggagattgtttgtgacgacgaccagtccgcggctacgggcatggccagcaatcatctggtcataagacccgacaggtgttcccttgcgggccagttcggtacggatttgaccggtatgtatcgctgcctgtgtatcgtaatccagaacctcaaggcgggagataaatccctccacgactgcaaaattacgctccggtgccaggcttttttcagcaccgtaaatcagctccattaaggtgatggagctgatacacattcgggatgtattgaggttgaagcgttctctgatgtgttcgggcttatttttgatggtgaaaatacaagtattggtatcaagcatgaatttcagcatcagaatccttcccgttcctgtactgcgggttgttctctggtgctcataaaatcagtactggcgccttcgccatcgaaccagctgtcccaggattctccgactggagtaatgattctgcttctaccaaccgcaatgatttcgacatgtttcacatcctccggaaaggatatcgatttaggcaatctgactgcctgggtccggttactaaaaaaaagtgttgtgtgcataactgccccctttctggatatacaacgcgtatatccattatgagtagaggcgatgtatatgtcaaagagatatacaggaaaaaataatccagtcacatgacgcgcactccgcagggcatccttgtccgactccggcatttctgaatacatccaatgaaggaaataccatgcaaacaatgcataaaaaacatatgtgcccatggcttctgcccggtttgctcggtctggctcggtgtgcgccagtaccgcatacttacgcagccatcattgaggcaggattttatccggaaggtacagatctccagcttgttcttaagataattgagaccgcgcgacaggaaatccgtctgatggactattccttcacctcttgggaggtggtccggttcgaacattcagtgagtacaaaattctccatgtcaaagtgatcgtcagcgacgaccgccacaccgaggtggacgcgtcagaatcgctgatcggacacgtcgcaatctacactctgacttataagccagcctgaaggggcatgttggctttgacgatcaggcaaaaaacaacggcgaataaagtcgtatgatgatcttcacatttatcatcatcagcgttcatattactcaacctgtaatcaacctctggcgtttttctgtatccatcacaaccatttccggtaaaggtaaaaaagggatttgaacctttccggagatgataatgaaggtaaatgcatggacaattttgcttatgtcggcgcatctgacggcctgtgccgtccctggcacagaaaaatatcagaccagcatggacagcgttacggcagaaaaaataagccggattatccagtcggatgtcattccttataaaggcgaaaaccatggagaagttatcagccgcgtatcgtctgcttttctcggaacaccttatcaggcggatacgctcatcggtgggcccggcatccccgaagtccttgtagcgaatttcaacggcgtggactgctttaccctggctgattacgttgaagccctggcccgcagcgataatcagaaatcgtttctgcataatcttgccaggactcgctacgccgcgggcaaagttgcttatctcagccgccggcacttcttctctgactggttcgccgcagcaccgcgtaatgcacgggatgtaacgccggatatcagccctgattatgtcgttgttgacaagcagcttaaccataaacctgatggcggcgagtacattcctggtctgggcatccatcctcgtaaaataaattacattcccggaagagccatcaaccagcaggtcatgaaccacctaaaaaacggggattatatcggtgtctactccccgcttgacgggctggacgtttcacatgtgggtatcgtagttcgccatgatgaacaggtgtggttcaggaacgcctcctcattggccgcaaacagaaaagtggtggacacaccgtttatggaatacatgcattccagactgggcatcgttgtgctgcgggctgaatgataaagtcattaccggagtcgccagctgataatagccgtccgacataggtattgaaaccctgtgtactgtggggccgacacggaaaattgctgtaaattcgtggatttagtaaatactagaagatatttgtctggagcgggcgaagggaatcgaggtatcgaagataatcagccgctaaccatttgcttcctaaaggatgatgaatccttgtggttacagttatggttacacattaatttatctctggtcaagtcctctcgtgactctggtcaagtcctctcgtgactctggaacgagtaaccgaagtcctaactttaagacagtggccccaatcgtccagacttgaaaggggccaaggggggagaggcaccgacctttgtctattagatacctacagagatttttgtgagattttttaatacaaggtcataacctaccgccaccagcccccaccgaccgcaaagtgaagacctgtaagcaccagagcaatagctattgcgggcatactgctgattgttattatctatcactccctgtagagcatctggcagaccaagtggacacagaggacgagctcaaacaactcctgtaagctcatggatgtactccttatgttcactcagggtttatagttactctggggtagtaaaccgaataacatgtatcaacgggaaagaggcgtctttctcaacgtcaaactcacctgctttcaccttaacggaaccagtagccaacacatcgaccacactgattaactcaaggtcatacccagcagtgttactatttcgggtcactttgacatctaccgtcttagcgtctttagttgacctgaaagagatagaagcgaaccgcttaggcaggagatagacacctgtatcatcgcccgcatagctgcatacagtgcagcccaatagctcactaatatcctcatgacctgcgcgttgagcggctcggtccaagattgcctcaagtctctcagggaccaatacagcgtaatcgctcagtgtatttcccaactcgaccggaagattcaacgctaatgtatccagaagatcttcagcttgatcagacggtttaccacttagtggggctgcctcaatgatttgaaggtctggcgtatctttcaggacatcgaccacagcggcgaacatctggcggctgtattgaacctgcatatcacctacagtctggattaatgccccctcggtccaaccgcccatcatatcgaagtcagatacatgagtagcagcagaacacaggatgcccgtcttattggtctcagggttcaacactggggtgacagttacgcttgcccctttgatggctgtggtagacggagcatccttagctggattaaacgcgccattatgcttaaagcggacggtgcgattctggagagcctgacggcgaataggcgtagggtcagtgccgtatgggcgaaactcacaagggaagacattctccattacagcagtgcggaagtctccatcattgaaggtctcatccaaagagtcctccagcgcctgaacaaaatcatgtgaatcattcccgaaggccatcggacggcctgagcggtccgtaaagcctacgttgagaacttgggcgtcttgaccattggtcatctgaacatagtcagtgcgtgagatgtcagtgccccatatagaccccttaatgatttgaccgtctttatctcgctgaggctgacgcagagaagccagtgaggatgctttgttaatttgatttgtaatagacacgatgaatatctccttattgtatgaatgcactacgtaaaaagtaactggtgacaccattggtcttatctcagaatccaagcagcgccaccgaaagttatcagttacagcccgaaagcggcccctttattgccgaagcgtttaatcaatgcttcctctcgggctttacgttcagcgaccgccttagcaatctcttctggtgtcgcatgaatagcagccatacgttcttgatgtgccttagcttctttacgtcggcgttcagcctcttggcgctcctgtgcgttgctttgagcccaccagcgggaatacttgccgtaatcacctgcatcaagaccagcggcgtgaatatcgttaagaatacgatttgagttcgccatgtcagagcctgtactgttcagcatggttgtaacgacaatttcggtgaaatacttagtggatagctcctgaccgaataccagtacagtttctttgtcagcgctcagtgcgatatccagtttgcgataagaaatagacatgtttgtttctcctttgaaaagatgttttaaaaggattaaactcatcggtcttccataggtattcctacggcgtctccccgtatcttggtcagttcaaaaggtggtgctagctgtgctagtgggttaattacatgaaatctcttggggtcagccctgcgtcaaccgccatgagacagagggcagctttagagtaatacgggcggttttccttggcaggcagacccagagtagctatcagtgccttggggggtaccaccatcaggcgtaacgccttacggccttctggtgtccttgggtcaatcttgattgtgtcatttgtgttattagtcatgaattacctcccctccagctttgctactgcctgtatgtgttgctgtttagcagcgtcgcttccatgaaccgctatgacctttctgtgcatcttgagtacgttttcaggtcggctgaagaactccagccccttagcgttaaaccgaatgtttataccgtttgggttgaatcgatggtcagtaggtttgataattcgaaagtactccacatagtttggattgactgaccactcgccactgcttgaatgtactcggaacagcttgcgctctttcttaaggatggtcatcagtttctgagcgggtagaccattggccttgcagtaatcgccccaagtcacgcctcgacgattagctgactgaatggctgctcgtttcttctggtcttccagttgaagaactcgacgttctaacgtctgaatatggtcgtaacacttggcgcgtaggtgaacagaatagccagcgaccagaataaaagtatgcttacggtcgagacggtacagaggctgctgtttcccctgcgcatttagatagacatcttcaatcacccctataggactgctcagttttgagcagtgctcagttttgagtgcgttaagctcctcaaccatattgcgaatatcacgaaggacatttcggtgctccttgcctgtcagctcagcaatttcaactgaggtcatggacacaagctggtcgaggttaatgatgctgatttcttgttgagacatagcttgatttcctttttgtttgcaccctgaagtcgcacccccactgacctactcaaagtccccaagcgaagggagaccagcaggacaacaggatgcaaacagaatgactttgagattgaatgaatgaatgacgatgattgtgtcgtagctgtgcggagctactgtatggtgaagcgcgagaggtggaactttgagagacacgtggtgagtggttcggagtgtgtctcctattagtaagtcgtattgattcgtattgattcgtattgatttactactgggagggtctctcaagggtctctgagccacgctaggcatcaggccatacgaaactacatggcatcctaaagaatggagtacaggaccatacagggccatacagttagcttctggggtaatgccttgaggagacctataggtttggtgattgattgttataaatatcatcacctcttaaggtattcccttagagttaatctttaattgtgtctttaagtaaactataagttaatactataagttaatctttaattgtgtctttaagttaactttaagttaagcccctgtagggtagagaccatatttaatatgatgtctattgctattcacttatcgactgacccagagcacacaggaagcattcactttaagtagaacgcttggtgtctgtaattggtcatcccgcccctgaaaggatgcgataagttacggttagagttagagttagagctacctgtagtagtagtagcaagtgtcccagaagagagagaaagagagaaaactttttgtgtcccttctccctatagtgagtcgtattagaaatccttgacaagtagtgaaaactgtgagtcaaaaacatgaccacacaggcctgtagcaatatggtcatcgactatggtcagcctcaaggcaaatctccccggggggggacagcttggttaccccacaatctccttataaacatcagccatcacattgaccagcctatcaacctcaacctctttagcataacggtcgtaagtaatagaccctgaactatgccccatgatcgcctgtgcatacgccaactcgaccccatgttgttttaactgggtcgcaactgtatgtctaaacgagtgaaacgctaagccgctacgatctgcgaggactttaggcaacaacgtccgattaaaccatttactcacctgctcaccgtaaccgttcttcatgaggcgaagaccatcgaacaccatagcgtcatcaccatcagcgcctctacgggtctcaaccaacctcataaagtcagccaatataaaaccataggccccatcgaccagaggcacacagcggtcactatgagcgttcttgatgctcttaccgggtagactactatcgtcttcattgatatgaatataaacggttcccgcctcagtggtcctgacgtctttgacctgtagttgggctatttcattgagtctcgccccagtgatagcagccaaggcggtaacataataatgatacggcttaccagaaggtctctgtgagtaaacttgggcggcagccagtagttgtcctacctgctccgtagagaaagcattacgcgcctcagaggctttacgctggggaaccttaagctctagcccttctgtcatattctttttaatcaggtcattacgcacggcccacttgaaaacagccgccatcttaatgagatatttattattgatggtaacaatatccagacaatcggttttatcctcacgacctagcaggtcaaccaacggaacatctttgaaacgctgcttacgattcttcggcaattgctggaggatatcccgaaccctaagcatatccgcacgagctaacacattggcgtcagcattgaggcccagataatcaaaaacctcgattaacgcagcatgagaagctttgttttctcgtaatgttgctggcttccagttctgggcgttttcctgctcgtactgctcaaagagagaagcaacggttacgcagtgtttgccttcagtaatgcttgttttttggggagcactaacagatagagttgcagaggcttggtcattagcaccagcagcagcatcaaatccatctatataatctataagtggctggctatctcccgcttcaatgcgcttcatgcaggccttgagtacattaagagcctcattaatatagcgatgctggtcaatagtcagtggctcgctatggacaagattctctcccacttccccatactggtcacggtatagatctctcatatctggctcgaagaggtctgaacgacctgtagacaactcccactctgcgatgtccctcaggtgttccctcatttcctcataggaggcgttgggtctgtctgcatggattgccctaagtgctgccttgatatgccgtgagtaagccatagctgtacgtctatccttagtccgtagtgatactgacgctattttataacggctatgggaaggatgtgaaacggtcaggcgatctgtggacttcatcctgaggcggatataaaagacgccattgcgctgataaagataggtttttgagttgagcatgtactgagatcttaagtctgctcactatttcaacaaatttagttacagtgttggttacagtgagtaaaactagcggaaggcttaaagccgtatcccttaggattcagtaggttggagtactttaagaaaggtcatggagcgggcgaagggaatcgaaccctcgtatagagcttgggaagctctcgttctaccattgaactacgcccgctttgagatgcgtaaggcattataaaccttacgctctggttggcaagagacttactggctgactggcgattaattcgccgtcagcacttcggtttactcccctgcggcggcagataacgcagcggatcgatggccgtcgcccggtagcgaatctggaagtgtagtcttacggatgcggcatccgtgctgcccatcgtagcgattttttgccccgctttaacgctttgtccattattaaccagcatggtgtcattatgagcgtaagccgtaatgtaatcttcattgtgcttaatcatgatgagattgccgtaaccgcgcagctggttcccgacatagacaactttacccgctcccgccgcataaacaggcgttccgcgcgcgcccgcaatatcgatccccttatttccgccctccgcggtggaataaggtaaaatcactttaccgttagcaggccatacccaacaacgctgccccaccggcggccaggaggattttggcaccgaagatgacggtctgaccgcagcagtttttgttgctgttttattgctggttttgcgtgttgaactgctactctttgcgctgccgcgcactttaattcgctgccccacctcaatagtataaggcggagaaatgccattcagtcgggccagttctttcacgctggttcccgtagcgcgcgatatacgatacaacgtatcgccgcgcttaacggtatagacggagccggaatacgttcctgagccggaattactggaacaccccgccagcagcagccctgtgcataacagcaccgcaatacccaggctatttttgttcaggcgtcctgcgctcaaaaccattcctcactctattgacagacgccttatgatagcagccaaatgccgtatgcccaatccattgacgccggaaagggtccgtgtggatgatgatgccgcgaatatccgatatgccagcataatatcgaatcacggcacaatagcgctcgtctgcgttctgtcagggcctgttttggtaatgcctttctttctgttatgcgctacgctgatcgtctgagtatatggcctggccatgctgccgggtcattttaattttcaggagctttcatgactgaggaacatgtcgttttattggatgagcaggataagccttccggcacactggaaaagtatgcggctcatacgcttaatacgcctttgcatctggctttctcctgctggctatttaacgaagatggccaattgctggtaacacgacggtcgctgagcaagaaagcctggccaggcgtgtggacgaattcggtttgcggtcatccgcaacaaggcgaaaccaccgaagaggcgatcatccgccgttgtcggttcgaactcggcgtggaaattaccgatctcacccccgtctatccgcacttcagctatcgggcgacagatccaaacggtattgtggaaaatgaagtctgtccggtatttgccgcgcgggcaaccagtgtgttacaggttaacagcgaagaggtgatggactatcagtggagcgaatttaaaagcgtatggcaaagccttctcgctacgccgtgggcatttagcccgtggatggtcatgcaagcgtcagacgaacaagcgcgtaaacgactgctcaattactgccagcgttaaagattgcctgatggcgctacgtctgaacgaagagatgccggatggcggctaatgccccatccggcaatttacatcttatttcaccggacgcatcgccgggaacagaataacgtcgcgaatcgtgtggctgttagtaaacagcatcaccatacggtcgataccaattcccagacccgctgtcggcggtaaaccgtgttccagcgccgtcacgtagtcttcgtcgtagaacatggcttcgtcgtcgcccgccgcttttgcattaacctgatccaggaaacgctgcgcctggtcttccgcatcgttcaactcgctaaagccattgccgatttcacgaccgccgataaagaactcgaagcggtcagtgatttccgggttcacatcattacgacgcgccagcggagacacttcagccggatattcggtgatgaaggtcggctgaatcagatgcgcttcagcgacttcgtcaaagatctcggtgacgatacggcccagaccccagctcttctcgacgtgaatgccgatgctttcagcaatcgccttcgcggagtcgaagttgtccagatcagccatatccgtttccggacgatatttcttgatcgcttcatgcatggtcagtttttcgaacggcttaccgaagtcaaacacttcatcaccgtatggaacctgggtggtgcccagaacatcctgcgccagcgtacggaacagagactcagtcagctcgatcaggtctttgtagtccgcatacgccatatagagttccatcatggtgaactcaggattatggcgcacggagatgccttcgttacggaagttacggttaatttcgaatacgcgttcgaagccgccaaccaccagacgcttcaggtacagttctggcgcgatacgcaggtacatgtccagatccagcgcgttgtgatgggtgataaacggacgggcagacgcgccgcctgggatcacctgcatcatcggcgtttcgacttccataaagccgcgagcaaccataaactggcgaataccggccaggatcttcgaacgggttttgaaggtattacgggattcatcgttagagatgagatccagataacgctggcgatagcgcgcttcctggtcctgcaggccgtggaatttatccggcaacggacgcagcgctttcgtcagcaggcgcagttcggtgcagtggatagacagctcgccggttttggttttgaacagcttacctttcgcgccgaggatatcgccaagatcccacttcttgaactgctcgttgtaaacgccttccggcagatcatcgcgcgccacatacagctgaatgcggccgcctacgtcttgcagggtaacaaaagaggctttacccataatacggcgagtcatcatacggcccgcgacggacacttcaatattcagcgcttccagttcttcagcttctttcgcgtcaaactctgcgtgcagttggtctgaggtacggtcacgacggaaatcgttcgggaacgggataccctgctcacgcagtgcagccagcttctcgcgacgtgccttcatttcattgttaagatcgactacctcgtcagcgccctgtgcgttttgttcagacatgttgattcctcatagccctgctttcaaacttgcttcgataaattgatccagactaccgtccagtaccgcctgtgtattgcgggtttccaccccagtacgcaggtctttaatgcgggaatcgtccaggacataggaacgaatctggcttccccagccgatatcagacttagtgtcttccatcgcctgtttttcagcgttctttttctgcatctccagttcataaagcttcgctttcatctgcttcatggcctggtctttgtttttgtgctgcgaacggtcgttctggcactgcgtcacgatcccggtgggaatatgggtgatacgcactgcggattccgtacggttaacgtgctgaccgcctgcgccagacgcgcgatagacgtcgatacgcagatccgccgggttaatgtcgatatcgatatcgtcgtccacttccggatacacaaacgcggagctaaacgaggtatgacggcgaccgccggagtcgaacgggcttttacgcaccagacgatgtacgccggtttcagtgcgcagccagccataggcatattcgccggagattttgatagtcgcggacttaatgccggcgacttccccttccgactcttcaatgacttccgtcttgaagccgcgcgcttccgcccaacgcagatacatacgcagcaacatgctggcccagtcctgtgcttcagtaccaccggaaccggcctgaatatcgagatagcaatcggcgctatcgtactcgccggagaacatccggcggaattccaactgcgccagcttctcttccagcgtattcagttccgcgacggcttcgttaaacgtctcttcgtcgtcagcttctaccgctagttccagcagcccggaaacgtcgtccagcccctgagtcatttgatcaagcgtatcgacaatcgcttcgagcgatgaacgttcttttcccagcgcctgcgcgcgctcaggttcgttccagacatccggctgttccagctcggcgtttacttcttccagacgctctttcttagcatcgtagtcaaagataccccctaagaacgttggtgcgttccgtgaggtcctgaatgcggttattcaccgggttaatttcaaacatggtctgatttcttttatttgacttgtcaaaatgcggttataagggtgaaatattagcggatttcgccccttaattacagcgaaagtgttgttaaatcgccccgatcatagcggccaaatatcatcgataataatctgtaaactacggttgccgcgaaactcgttaatgtccagtttataagccagttctacctcccgcacgccgttatccggccaacaggtcgtatcaatattaaatgcgatgccatccaacagcgggccgccgccgacaggctccaccatcaccttgaggtggcgctcgcccaccagacgctgttgtagcagacggaaacgaccatcgaataacggttccgggaacatttgcccccacggtccggcatcccgcaacagttgcgccacttccatagacatctccgccgcgcttaatggaccatcggagatcacctcgccttgcaacagggcaggatcgagccattccgtcaccagctcgccaaaacgttgctgaaactgctcgaatttatgctcttccagcgacaatcccgccgccatcgcatgaccgccgaacttgatcatcagatcagggtaaagcgtatccagcctttccagcgcatcgcgcatatgcaacccctgaatcgaacggcctgagccttttagcgtgccgtcgcccgcaggtgcaaaggcgatcaccgggcggtgaaaacgctctttaatgcgcgacgccagaattccgaccacgccctgatgccattcaggatgatacatcgccagaccgcccggaagcgtttcactactgcgctcaagcttttcgcacaggataagcgcttccgcctgcatcccctgctctatttctttgcgcgtctggttaagcgcatccagctcgctggccagaacacgcgcttcgccgaggttgtcgcacaacagtaacgccacgccaacggacatatcatccagcctgccggcggcattcagacgaggccccaacgcgaagcctaaatcactggcggcaagctgctgcggatcgcgattcgatatctccagcaacgctttaattcccggacggcatttcccggcacgaatacgacttagcccttgccaggtcagaatacggttgttggcgtccagcggcacaacgtctgctaccgttcccaacgccactaaatccagcagctccgccagattcggcggcgcgatgccgcgctcgtcgaaccatcctttgtcgcgcaaaaatgttcgcaacgccagcatcaggtaaaacgccacgccgacgcccgccagcgacttagacgggaattcgcagtcgcgcagattgggattaataatcgcttcggcatccggcaacgtgtcgccaggcaggtggtgatcggtcacgatcaccggaatcctcaacgtctttgcatgcgctacgccagcgtgggatgaaatgccgttgtctacggtgacgataagctgtgcgccgcgcgccttcgcctgatcgaccacttccgggcttaaaccgtagccgtcctcaaagcgattaggcaccagataactgatgttgtcacatcccaacgcacgcattcccaatacgcttagcgcagtactggtcgcgccgtcggcgtcaaaatcgccaacaacaataatgcgggtaccttcgcgaaaggcgttgtagaggatctccaccgcgttatctatgccgctaagctgttgccagggcagcattcctttcacgctgcgctccagttcgcgggcgctacgaacgccccggctggcatatagacgtcgtagtaatggaggaagatcggcggggagttccgccgtctcatcagcctcgcgccgacgaagttgtctctgttgtttcacgcgtattatttaccactggtctgtttttgatgctcatcaagaaacgctttcatctctttcggtccctgatagccaggcaccacatagccgttactcaatacaatggctggcgtaccgctaacgcccaactgcacgcccaacgcataatgatcagcaatgttcacgtcacagcttgccggtttcacgcccttacctgccatggcgtcatcaaacgctttgtttttgtctttggcgcaccagatagatttcatatcctgctccgcctggctttccagcccctggcgcggaaaagccagataacgtaccgtgatccccagcgcgttataatctttcatctcttcatgtagcttatgacaatagccgcaggtgatatcggtaaaaacagtaatgacatgtttctcatccggcgctttatagacgatcatctctttttccagcgcatttagctggctcatcagcagtttgttcgtcacatttaccggatgcgcgccgctcacgtcatacatcggcccttgaataatatgtttgccgtcgtcagtgacgtacagtacgccgctgtgagtgaggacggttttcatccctgccactggcgaggcctgaatttccgtactctgaacgcccagcttagccagcgactgacggatagccgcatcatccgcatgggccacgcctgaaaacgccgccgccagtaaagtgaacatcataaaacgctttttcataaactatcctttcctgtcagcactcatgcccgcggatggtgctgttgatgaagttgacgcaaacgctccgttgcgacatgcgtataaatttgtgtcgtcgaaagatcgctatgcccaagtagcatttgtacaacgcgcaagtcggcgccgtgattcagcaaatgcgtggcgaaagcgtgacgtaaaacatgcggcgatagtttttcgctatcaattccagccagtaccgcataatgtttaatacggtgccagaaggtctgtcgcgtcatctgctgcgcacgctgactggggaataatacgtcaatcgatacgccattgagtaaccagggacgcccatgctccagatacgtttccagccaatataccgcctcttcgcctaacggcaccaaccgctctttattgcctttaccgataacccgcaccacgccctgccgcagactgatatcgctcattgtcagccccaccagttccgacacgcgcaaaccggtggcatacagcacttccaacatagctttatcgcgcaactccaaaggttgatcaataagcggcgcctgcaagagccgttcaacctgcgcctcgctaaggtctttcggtaaacgctgcggaagcttaggcgaggccaactgtgcgctcggatcatcctcacgatacttttcacggtacagatgctggaaaaagcgccgcatagcgcttaacaggcgtgcggagctggtcgctttgtatccgccctccacccgttcagccaatagcgtttgtaaatcatcagcctgcgccgtcgcaagcgtttttccgcgatgatgcaaccacgcaacgaccatcgataaatcgcgacgatacgcgcttaatgtattttccgccagatttcgttccagccacagggcatccagaaactgctcaatacgcgctaaatcctgttccattcgcgctccctacttcacgcttacttttggtgcattatgcctcattgtgccgtgaatgcagcgattctgttacactacccgcaacgctatagcagaatcgagatgtaacgtaatgaacatgggtcttttttacggttccagcacgtgctacaccgagatggccgcagagaaaattcgcgatatcctcggcccggagctggtgacattacataacctcaaggatgacgcccccgccttaatggagcagtacgacgtgctcattttaggcatccccacctgggattttggcgaaattcaggaggactgggaagccgtctgggagcaactggacgatctcaatctggaaggcaaaatcgttgcgctttacggtatgggcgaccaactcggctacggcgagtggttcctggatgcgctgggtatgttgcatgacaaacttgccctcaaaggcgttaaatttgtcggctactggcccacagaaggctacgaatttaccagcaataaaccggtcattgcggatgggcaactgtttgtcggcctggcgctggatgaaacgaaccagtacgatctcagcgatgagcgtatacagacctggtgtgaacaaattctcggcgaaatggccgaacactacgcctgaagccttactcgctgtatttccctctcgacggaaccgcgtttgcgtcgttccgtcagtgttggcgctatatcggctgctgtaacagtatccgacgcaactcacgccattccgcttcttccatgctatccgccgccagccataaatgctgatgacgtccagactctgcgcgtaaacgcaacaccatcccgctcttcagtaaccagggaggacgcaagagcgtccagtcctgtccctgccagcgtaagcgcccgtccatgagtagcttgatctctccctggcaggtattaatcctgcgctggctacgtacacagtcaaacacgaccagcgacagtagtatcatccataacggggtataactcagcggccagggcatcaataaaatcaccgcggcaaccagcccatgaaggagcaatgagatccactgagcgcgccatgagacgcgtaaatcagattgccacaggaccacgttcccgattccgtgtctgaatgagtcggaccatctgttccagttcagcgtcagccggtttaccgtgattcattaaccagttaaataaatccgggtcatcactctgcaacaaacggacaaaaatacgcttttcttcatcacttaaactatcgtactcatgttcaaaaaacggcatgatggaaatatcaagttcgcgcataccgcgacgacatgcccagtgaatacgtgctttattgtgaatatccatgttcttcctgcctcgcgaaaatgaagtaccgggctattgtaacgtgtttttggcgttgttttacgggaatctcagtaatctggaacgcgatcgcgaaatagaaggctgggaatcaatatgttcatccgttttggataccacctcgcaaaacgatcaatccgctttcaatgggctatttaaagcacttgcaatgaccgatggctcttttaccattaaccattattgttgcagctaaccaggacattatttatggcttttatctcctttccaccacgtcatccctcatcgtcagcccgcctgccgctgacgctgatcgcgcttgacgactgggcgctgtcgtccattaccggcgtagacagtgaaaagtatattcagggccaggtcaccgctgacgtaagccagatgactgaacagcaacaccttctcgccgcccactgcgatgctaaaggtaagatgtggagcactctgcgactgttccgtgagcgcgacggtttcgcctggattgaacgccgtagcgtgcgtgaagcgcaattaacggagctgaaaaagtacgccgtattttccaaagtagtcatcgcgccggatgacgaacgcgtattgcttggcgtggccggttttcaggcccgcgcggcgctggctaatgtctttagcgaactgcccaatagtgaaaatcaggtggtcagagacggcgcctccacgctgctatggtttgaacatcctgcggaacgattcctgcttgtcaccgatgtcgcgacggccaacatgttaacggagaagttgcatggcgaagccgaactgaataacagtcaacagtggctggcgttggatattgaagcaggcattccggtgattgacgcggcgaacagcggtcagtttatcccccaggcgactaacctacaggcgctgggcggcatcagcttcaagaaaggctgctacaccggacaggagatggtcgcacgggcaaaattccgcggcgccaataaacgcgcgctttggttgctggcgggcaaagccagccgggtaccggaagcaggagaagatctggagctacagatgggcgagaactggcgtcgtaccggcgctattctggcggcgacacagttggacgatggtcagttactggttcaggccgtcatgaataacgatttagaagccgaaagcgtcttccgcgttcgcgacgatgccaacaccctgcatatcgtcccgctgccttactcgttggaagagtgatatcacgttaaaagtcggatagcctgatagcgcaacgccatcaggctcgcacgtgctgctctcgtaggccggataaggtacgacagcgccgccatccggcacgggcatccgggaattacgcctgtcccacatacaaatagatggccaggaagtggcacacgctgccgcccagcacaaagccatgccagatggcgtggttataaggtatgcgtttgcaaacatagaaaattacgcccagcgagtaaacgacgccacctaccgccagcagcgtcacgccgcctatcgccagcttaatcgccaactgataaaccactatcagcgacagccagcccattgccagatacgtaaccagtgaaagcactttaaatcggtgcgcaatcgtcaacttgaagaggataccgaatagcgccaggctccagatcacaatcattagtccgcgcgccagcggcgaatccagacctaccagcagaaatggcgtataggttccggcaatgagcagatagatagcgcagtgatcaaatttctttaaccagatttttgcccgctgatgaggaatggcatgataaagcgttgaggcaagaaaaagcaggatcatgctcccgccatataaactgtagctggcgatagccgtcatacccgcattcgcctctaccgcctgaaccaacaacagcaccaggccgacaataccaaataccaatccaatgccgtggctaatactgttggcgatttcctcagccagcgaatatccctgcgtcattaatggtttttgcaccataacttactccggagaaacgttcataacgatgaactgcacctctagcgtaactgagaatggttccagtgaacacatgttagctaaaataaattcgcaaaattaaattttgtttattattcaacaaattaactacaaaaactcaactaacacgcgttcatatttatcaaaggcatttaaaatcaatcacataaaattgcgtctggttgggatagatttcagcaatgacccgtttcagctcatcaagcgacatattttcctgttgcgcatgtttttcgttcaacgtatccagcgtcacagttgacgttcctgtcacttcgattgtgcaaaaatagccatcatcttcgaaccgccccacgcgtagagcatcgcctgctttaaagtgggactcggaggcatcacgaatagtgatggttttacgccctgccagaatgtcattctggaaacgttgaaagaaagtaatgtcatttggctgcatgtggttatccccctgaatatggccccttgaagtggatgttacgatctgaatgtgttcttgccccgacacgcgagcatcctggaattttgcgtacgctttacatgccacttggtgcagaatgaatgataacagactaaataaattgagattatgcaacaatgagaaaactcaccctgccaaaagattttttatggggcggcgcggttgccgcacaccaggttgaaggcggctggaataaagacggtaaaggccccagcatctgcgacgtgctaaccagcggcgcacacggcgtgccacgcgaaatcacccagaatgtcgttgctggcaaatactatccgaaccacgaggcggtggatttttacggacattacaaagaagacatccgtcttttcgccgaaatggggttcaaatgcttccgtacttctattgcctggacgcgtatcttcccgaatggcgacgaatcccagccaaacgaggccggtctgaaattctacgacgacatgtttgatgagttactcaaatacaacatcgaaccggtcatcaccctttctcactttgaaatgccattacatctggtacagcactacggcggctggaccaatcgtaaagtggttgatttctttgtccgttttgctgaagtcgtgtttgaacgctacaaacataaggtcaaatactggatgaccttcaacgaaattaacaaccagcgaaactggcgcgcgccgctgtttggctactgctgttccggcgtggtgtataccgagcatgagaatccagaagaaaccatgtatcaggtcttacatcatcagtttgtcgccagcacgctggcggtaaaagcggcacgtcgtattaatccacagatgaaagttggctgtatgctggcgatggtcgcgctgtatcctttctcctgtaaaccagaagatgtgatgtttgctcaggaatcgatgcgtgaacgctacgtctttaccgatgtgcagctgcgcggctattacccgtcctatgtgttgaacgagtgggagcgccgcggatttaacatcaaaatggaagatggcgatcttgaagtgctgcgcgaaggcacctgcgattatcttggtttcagttattacatgaccaacgcggtcaaagccgaaggcggtagcggcgatgcgatttccggttttgaaggcagcgtaccgaacccctatgttaaagcatctgactggggctggcagattgacccggtgggtctgcgctattcattgtgtgaactgtacgaacgctatcaaaagccgctatttattgtcgaaaacggttttggtgcttacgacaaagtagaagaagatggcagcatcaacgacgactatcgcattgactacctgcgcgcccatattgaagagatgaaaaaagcggtgacttacgatggtgtcgacctgatgggctacacgccgtggggctgcatcgactgcgtgtcgttcaccaccggtcagtacagcaagcgctacggcttaatctacgtgaacaagcacgatgacggtacgggcgatatgtcgcgttcgcgtaagaagagcttcaactggtacaaagaggtgattgccagcaacggcgagaagctttaactcctgcacgttacccgccagtcggcgggtaacactttgaacgagtcttaccaggtcttacctattttaaattcccagcgtacatcttccattttggttggcgacttcgcttcctgcattaccgggaagaaggctccggcaccaaaccataatttcagtgaatcgacggcaatattaaatgacggaccaacaacccattcggtagttccagaatggttattaattacgctgccattagacagttttttcgttccagaggcattattgctgtaggcactttccagaccaagatccagcggtaaatcgctaaacatataccgcacctgggtattccactggaattcgttacctcgtttcacgtcctggttaccgcgctcaaatggtccctgatatacaaaacccatatcccctttaatgttaggagtaaataattttgttaaagtgagtgttactcttcctccccaggcgctattcccaggcaaatgattatctccatcttgcccggtgggtagtaatactgccccacctaccgtaacccaaaacggatcacctcttcgctggctcattaaagcataattgacccccaccgattggtcgctcattccctctatgtgctcaggagacagattgtctcgtttgttattgatataggaacccacagttgataattccagtctgtcggtcaaaccgtaacgaatcttcaataaccatatctgggagtaaacatccggacttccgtgcccctcgatttgatgatctttatcgcgaaatgagctattcacggcggttaataactttccttccggcaatactgaaccaccagaaatagcggtattaactggtgcacctaatagattactgggattattttctccgttagctgccattgcattcattaatagaaaatatgtcattaatggcagaaatataaatcgtttcattattccctccaggtataaaaaacaaagcgctaagttaataaatatttacgttatttatgcttatttttaatttataatttaaattaatagcttgatgaatttaatatacggaaatttttgtaactatattgagaggtaaataacgattccgaagagaaactatttgtaactatatgtaaatatgctgtgttgttttgattaaataacagcaaggtaaaaatgatgcacaatgaatcattaggctctaaaaaaccggtaatttaattctggctaatacactgatacaaacgccaggttgcctgacaggagccaacgatttactgtaatatattgaattagtaacactttgtagcctgaataaggcactcacactgcatccgacataaacaaaacgcactttattaacaagctgaaaaggcgccgaagcgcctttagaaaacagtcgaatcagtaaattactggtagtcgctaatcggtacgcaggagcagaacaggttacggtcgccataaacatcatccagacgtttcaccgtcggccagtatttgtctgccacgcctgccgggaatacggcaacttcacggctgtacggatgcgcccactcggcgaccagttcgctctgaatgtgcggcgcgttcaccagcgggttatcttccagcggccagacaccggctttcacctggtcaatctctgcgcggatagccagcatcgcatcgataaagcgatccagctcagccttaccttcagattccgtcggctctaccatcagcgtgcccgccaccgggaacgacatggttggcgcatggaaaccatagtcgatcagacgcttggcaatatccagctcgctgatgccggtttcttctttcaatgggcgaatatcaagaatacattcgtgcgccactcggccatcgcgaccggtatacagtaccgggtacgcgtctttcagacggctggcaatgtagttagcgttaagaatcgcgacctgacttgcctgcttcaggccttctgcgcccatcatgcggatgtacatccaactaatcggcaaaatggaggcgctgccgaacggcgccgcagacaccgcgccctgacgggtgagcatcccttcaatttgcaccacgctatgacccggtacgaatggcgccagatgcgctttcacgccgatcggtcccatgcctgggccaccgccgccgtgcggaatgcagaaagttttatgcaggttaagatgcgaaacgtccgcgccaataaagcccggtgaggtaatgccgacctgagcgttcatgttcgcgccgtcaaggtaaacctgaccgccgaactggtgcacaacttcacacacttcacggatcgtttcttcatagacgccgtgggtggacggataggtcaccatgatgcaagagaggttcgcagcatgttgttctgctttggcccgcagatcgtccaggtcgatgttgccgttcttatcacacgccacaaccaccacctgcattcctgccatatgtgcagaagcagggttagtgccgtgagcagaggccggaatcaggcagatatcgcgatgcccttcgttgcggcttccgtgataatgacgaatcgccagcagccccgcgtactccccctgcgcgccggagttcggctgcatacagacggcgtcgtacccggtgagtttcaccagccagtcagaaagctggctaatcatctgatgatatccttcggcctgctccggcgggcagaacgggtgcagttcagcgaattccggccaggtgatagggatcatctcggcggcggcgttcagcttcatggtgcaggaacccagcgggatcatcgcctggttcagcgccagatctttacgctccagcgagtgcatatagcgcatcatctcggtttcgctgtggtagcggttaaataccggatgcgtcagaatcgcatcgtcacgcagcataccttgctgaatggaacggctatcaagcgccacgtctttatccagtgtttcaatgttcagaccgtggctgtcgcccagcaaaacattgaacaactgcgccacattctcacgggtggtggtttcatcaagggtaatacccaccgcgttatgaatatcgctgcgcagattgatctctgccgcttccgcacgcgccagtaccgcagctttatcagctacttccacacacagcgtgtcaaagtagtgcgcatgacgcagctttaagcctttctgttgcagaccggccgccagaatatcggtcaggcggtggatacgattcgcaatgcgtttcaggccaaccggtccatgataaacggcatacagactggcgatgttagccagcagtacctgcgaggtacaaatgttggagttcgctttctcacggcggatatgctgctcgcgagtctgcatcgccatgcgcagtgcggtattgcccgccgcatcttttgagacgccgataatacggcctggcatggagcgtttaaattcgtctttggcggcaaagaacgccgcgtgcgggccaccgtaacccatcggtacgccaaaacgttgcgcagagccgaaaacaatatccgcgccctgtttgcccggcgcggtaagcagcaccaacgccataaaatcggcggcgacgctgacaatcaccttacgggctttgagttcgctaatcagcgtgccgtagtcgtgaatttcgcccgtggtgcctacctgttgtaacagcacgccaaatacgtcctgatgatccagcactttgtccgcgtcatcgacaatcacgtcaaagccaaaggttttggcgcgtgtacgtaccacgtccagcgtttgcggatggacgtcagccgccacaaagaaacggttggcatttttcagtttgctgacgcgctttgccatcgccattgcttcggcggcagcggtggcttcgtcaagaagagaagccgaagccatatccagtccggtcagatccagcgtcacctgttggaagttgagcagcgcttccaggcgcccctgagagacttccggctgataaggagtgtaggcggtataccagcctggattttccagcatgttgcgcaggataaccggcggtagctgcacggcggtgtagcccatgccaatgtaggacgtgaagcgcttgttacgcccggcgatggcttttaattccgccagtgcggcatattcggttgccgcctcgccaacctgcggcggagtcgcgagctgaatgtctttcggcacaatctgacctgtcagcgcgtttaacgactcggcgccaaccgcattcagcatctcttgctgctgcgcggcgtccggtccgatgtggcgttcaatgaaagcgccgcggttttcaagctggcttagcgtctgtgtcatgggcgatggttcctgaaacgtgcagtgaatcgtaggtgtctctaactcaattgcccggtggcgctgacgcttaccgggcctacgcgtgcgaaaacgaatacgcaaaatcattcgcgttgcagtgagtaggccggataagcattagcgccatccggcacaacattattcgtcttctaacaatgcctcatacgcggtggcatccagcagcgattcaagctcgctttcatcgctggctttgattttaaagatccagccaccggcatacggttcgctgttcaccagctccggggagtcgctcagcgcatcgtttaccgccacgatctcgccgcttaccggcgcataaatgtcggacgccgcttttacggactccgccacggcgcagtcgtcgcccgcgcttacggtcgcgccgacttccggcagatcaacaaaaaccatatcgcccaacagctcctgagcgtgttcagtaatgccaacggtgtaagtgccatccgcttctttacgcagccattcgtgttctttgctgtatttcagttctgcgggtacgttgctcatcaattaatctccaaaaaaggatgaatcacgcgacggctttgccgttacgcacaaaaacaggtttagtcacttttaccggcatttcacggttacgaatttgtacaatcgccgtctcgccgatgcccgccggaacgcgcgccagcgcaatgctgtagcccaacgttggggaaaacgtcccgctggtgataatgccttcttgctgattgccctgcgcatcggtaaaacgcaccggcagttcattacgcaatacgcctttctcggtcatcaccagaccgacaagctgctcatggcctttttcacgctgcatctccagcgcctcacggccaataaagtcgcggtcagcaggttcccaggcgatagtccatcccatattagccgccagcggagagataccttcatccatctcctgaccgtacaggttcatgcctgcttccagacgcagcgtgtcgcgcgcgccaagaccgcacggcttcacgcccgcctccaccagcgcacgccagaaatccgccgctttttcattcggcatggcgatttcatagcccgcttcgccggtataaccggtggtggcgataaacagatcgcccgcctgaacgccgaagaacggcttcataccttctactgcatggcgctgttggtcagtaaacagagtcgccgctttttcctgcgcattcggcccctgtaccgcaatcagcgacaggtcgtcacgaacggtgatgtcgatggcataaggttcagcgtgttgggtaatccaggagaggtctttttcgcgggtggcggagttaacaacgagacggaagaaatcttcagtgaagtagtagacaatcaggtcatctatcacaccgcccgatgcgttaagcataccggagtagagggctttacccgtcttcgttagcttcgcgacgtcgtttgccagcagataacgtagaaactctcgtgtacggctaccatgaagatcgacaatggtcatatgcgatacatcaaacatcccggcatcggtgcgcacagcgtggtgttcatcaagctgagagccgtaatgcaggggcatcatccagccatgaaaatcgaccatgcgggcgccgcatagcgtgtgttgttcgtacaaaggcgtctgttgggccatcttttcctcgttgaattagcgggggctaacaaccattttcatgggaaatcttcgccacgaaacctggcatcgacgccctttttcctgcgccgacgcaaacgttctcttgctcctgaacttaccaccgaaccaggcgctaaaccataaggctgaatttaccatcacattagcttatgactaaaaaacgctaaaatcccatcagcacaaaaaaccactattacgctaaataacttccataaaaatgaagctgatacgatttatcacaacataaattaatattaaatgcggaaaaaatgtcgaaaatcgcgttctccaaaaatagtggcattagaaaatataatgcgaaataagcggtgaaattagattatttcaaacgaggaaagccccccggcgcgatagccgggaaagcaaagtgtgacgggtttcaaactcttgctggcgtgcagtcagacgcttaacgaagccattgcggaaggtcgtttagccccattgcctggcgaagcagttggggtttgacgccggggagcgtgtccgccagtttcagtccgatgtcgcgcagcaatttttttgccgggttttcgccggcaaacaggtcacgaaaaccttgcatcccggcaagcatcatcgccgcgctatgtttacggctacgctcataacgacggagataaagatgttggccaatgtctttgccctggcgctgaagccggcacagatcgtccaccagttcggccgcgtccataaaaccgaggttgacgccttgccctgccagcggatggatggtgtgcgcggcatcgccgaccaacgccagacgatgcgcggcaaactggcgagcatagcggcccgtcagcggaaaaacctgccgttcgctttccaggcggcataagcccagccgattatcgaaggcgatagtcaacgcctggttaaacgcctcgtcgccgctctgttgcatacgctccgcatcctgcggagaaagcgaccagacaatggaacacagatgcggatcgcttaacggcaaaaacgccagaataccttcaccatgaaacacctggcgagcaaccgcgccgtgcggctcttcggtgcggatagtcgctaccagcgcatggtgacggtagtcccagaaagttaagggaatatccgctttgttacgcagccaggagttggcgccatccgcggcaatcaccagacgcgcggttaacatcgcgccgtcttttaaagtcaggaaggcgtcattctctccccaggcaacctgctgtaactccgctggcgccattaaggtgatatccgccgcttgctgcgctttttgccacagtgcatagtgaatgacgctgttttcaacaatatgccccagatggctatatcccatgcttgcgtcatcaaacgtaatacggccaaagctgtctttatcccagacttccataccgtggtagcaacttgcccgtcgcgccacaatgtttgaccatacgccaagacgggtaagcagtttttcgctggcggcattaatcgccgacacccgaagctgaggcggcgcatcgttcgccaactgctggggaacaacgtgatccagtaccgcaacgcgcaaaccgctcccctgcaagccgcaggcgacagccagtcccaccatgcctccgccaactattgctacatcaacactttgcactatttactcctggaaaccggaacaatcaaaaccgtaggccggataaggcgtttacgccgccatccggcatttttacgaacacgatgccggatggcggcgtaaacgccttatccggcctacagatctgcttaacgcgcaacccaacctaaggttcgctgtgccagcgcatcgcgcgcaggtggtaataattccatcgccattaaaccgatattgcgcccaataaccagcggcgcccaacgatttgcaaacagatggaccagaccgttcgttacgccaatcgtcgtatcccggtcaacctgacgacgctgctgatagcgcgataacacgtgccaggcgccaatatcctcgcccgcgtcctgtgccgcgaccagcgtttccgccaggctcatgacatcgcgcagaccgagattaaacccttgtccggcgataggatgcaacgtctgcgccgcattgccgaccacgacagtccggtgagtaaacactttcgccgccgtagtcagggcaagcggatacgcgctgcgcttacccgcctgagtaattcgccccagccgccagccgaacgcggcctgcaacgcatgacagaactgcgcgtcggaccagctcagcacctcatcgcgctggtcgagcgggtgacaccaaaccagcgaacatcggccatgcgacatcggcaacatcgccagcgggccattgggggtaaaacgttcaaaggcgcgtccctggtgcgggatagcggtcgcgacattcgctatcaccgctaactgttcgtaaggctcctgatgccagtcaacgccgcaggctgatgccagcgcggagtgggtaccgttagccgccaccagcacgctgccagctatcacattgccgttttccagagtgacgttaacctgctgttgggtacgcgacacgctggctacgcgctccgggcagtgcagcgtaacgcctggcgctttacgcaagagcgcaaacagacgcagcccgatatcatgcagctccgcaacgtgacccaacgctgccaggctgtaatcctgcgcgtctagagtcacaaatccggcatgaccgcgatcgctgacgtgtacggtgttgattgccgttgcgcaatcggaaatcgcctgccagacgccaattcgcgccagttgctggcaagtgcccgccgccagcgcaatcgctctggcgtcaaagccgggatgaccgtcggcttcaggcgctttcgcttcaatcaggtgtaccggcaacgtcccatgactgaactgagagatggccagcgccagcgttgcgcctgccatgccgccgccaacgataatgacgctcattgctgccgcgccgccgccattaatgcctcaatgtcatccgccttcttcacaacgccagcggtcaggttttcattaccggtttcggtaatgacaatgtcatcttcaattcgaacgccaatgccgcgatacgcttccggcacgtcggcatccggcgcgatatagaggcctggctctacggtcagcaccatgcccggctccaggatgcgggagcgatccggcccataaacgccgacatcatgaacatccagccccagccagtggctcaagccatgcataaagaaaggacgatgcgcattctcggcaatcagttgatcaacctctccttgcaaaatccccaacttcaccagcccggttatcatgatgcgcactacttcgccggtcacctgctgaatagaggtaccaggacggaacagtcgcaggctggtctccagcgattccagaacgatgtcataaatttcacgctgagctggcgtaaatttcccgttcaccgggaaagtacgcgtgatgtcgcccgcgtaacctttatattcacagcccgcgtcgataagcactaaatcgccgtcgcgcatttcactttcgttttcagtgtaatgcaggatacagccattttcgccgctgccgacaatggtgttataggagggatagcgcgcgccatggcgattaaattcgtggtgaatttcaccctccagctgatactcaaacatccccggacggcatttttccatcgcgcggatatgcgccagagcgctaatttccccggcgcggcgcaggacagcaatctcttccggcgatttgaacaggcgcatctcatggacgatcggtcgccagtcagtcatggtggccggcgcggtcagattctggcgggagcctttacgcagcttctccagcgcagccagaacaatctcgtcggcatacgcatattcgccctgcgcgtggtacaccacatccagaccattaagcaactgaaagagttgctggttgatttcgctaaacgccagcgcccggtcaacgcccagtttttccggcgcggcatcctgtcctaaacggcgaccaaaccagatttccgccgtcaggtcgcgaacgcggttgaacaaaacgctgtggttgtgggtgtcatcactcttaatcagtaccagcacggcttccggttcgttaaaaccggtgaaataccagaagtcgctactctggcgatacggatattcactgtctgcgctgcgcgtcgcctccggcgcggcaaagatcagcgcggcgctgccgggctgcatttgcgccagtaatgcctggcgacggcgttggtattcctgctgagtcatgacatggcctccatttcgttttttcttagtgtagcgtcggtttacgcacttccggcgcggtcggctgttggcgcgtgaaagtgtcatgacataacagcgccgcaacacggacatattcgatgatctcttcgagcgacatctccagctcttcctgatcttcgctctcatcataaccaagctgcgcaatattacgcaggtcgtcaatcgcttcacccgtttcgccggtgactttatcaagtttaggctgcgttacgccgaggccaagcaaaaagtggttaacccacccggctaatgcatctgcgcgatcgaatacgctgacatcgtcgccttcaggcagataaagctgaaaaagaaagccgtcgtcttccagcgcgtcgctggtcgccgcgtgcattttgcgcagcgcctgagcaagctcatgcccgaaggccagaccttcgttcgtcaggtcatgcaacagcggctgccatgagctgtcgttgttgccgccgcaaatcatcccgctgattaaaccatgcatttcagccggggtcagaccggccccttgttgattcaaaaaccggttcatttcgtcgtaaccaggcatttcgttctgtatagacataagcattcgtcatcaaagggaggatattcatgatatgctaccactttggaccctggtgaaccagaaaagggcttgtatcttcacaccagggtagctatagtgtcgccccttcgcggaccctgggtctggagacgaaggcagcgcagtcaatcagcaggaaggtggcatgtctgcacaacccgtcgatatccaaatatttggccgttcactgcgagtgaattgcccgcctgaccaaagggatgcgttgaatcaggctgcggacgatctgaatcagcggttgcaagatctgaaagttcgtactagagtcacaaatactgagcagttggttttcattgccgcattgaatatcagctatgagttaactcaggaaaaagcgaagacccgcgattacgcggcgagcatggaacaacgtattcggatgctacaacagaccatcgaacaggcgttgcttgatcaaggtcgcataaccgaaaaaacgggccaaaactttgaataacacttttcgctttactatggtaaagtgattgtgaaaacagtatttctctgagatgtttgcaagcgggccagtcccctgagccgatatttcataccacaagaatgtggcgctccgcggttggtgagcatgctcggttcgtccgagaagccttaaaactgtgacgacacattcaccttgaaccaagggttcaagggttacagcctgcggcggcatctcggagattccccttctgactggcgacagccatgacgcaacttcccgaactctctttatcacgacaagaaatccgccgaatgattcggcaacgtcgccgtgcgctgacgccagagcagcaacgccgctttggtcaacaggccgccgcccgaatgctcagctttcctcccgtcgtgatggcgcacactgtcgccgtgtttctctcctttgatggcgaactcgacacccagccgctgatagaacagctatggcaagcgggcaagcgcgtctaccttccggttcttcatcccttcagccctggcaacctcctgtttctgcactatcatccgcagagtgcgctggtgaccaaccgcttaaatatccgggagccacggcttgatgtccgcgacgtattgccgctggcaaagctggatgtgctggtaacgccgttagtcgcgtttgacgaaggcgggcagcgtttaggcatgggcggcggtttttatgaccgcacgctacaaaactggcagcagcataagatcctacctgtgggctacgcgcatgattgccagttagtagaaaaactgccggttgaagagtgggatatcccgctgcctgcggtggtgacgccgtccaaaatttgggagtggtagccgtgttttgtcgattgacagcgtcgcttttttgacctaaatttctcggtgaagggtgagggaggcgaacctccctcctgcgtactcactgttaatatgctgggcaagcgatgattaacaggatcagcagcatgatgacgtatctcatcatcgtccctttcctttttagagcccctgcctcggtaggggctttcccgtttcagcgctatgctgagcccttatcgtaaattccttttattgctgtacaacacgcaacgctgcctttaattaccaattgcggcaaggctcgaaaacagaatgtatgcgttacacgaagagatgttgaggcagggaaaccagagaaaggatgggcaggtcatctcctgcccatttagaggaaattagtacagcagacgggcgcgaatggtgcccggaatcgccttcatcgccagcagcgctttctccgccacatcgccatcggcttctatatcaattaccacataccccattcgggcggaggtttgcagatactgtgcggcaatgttaacgccctgctcggcaaagatctggttaagcgcggtcaatacgcccgggcggttttcgtggatgtgcatcaggcgacgaccgccgtgcagcggcagcgacacttccgggaagttcacggcggacagcgtcgagccgttatccgagtacttaatcagttttcctgcgacttccagaccgatgttttcttgcgcctcctgcgtcgagccgccgatatgcggcgtcaggatcacgttatcgaattcgcacagcggagaggtaaacggatcgctattagtggccggttccgtcgggaagacgtcgatagccgcccccgccagatgtttcgtcgccagcgcgtcgcacaaagccgggatatccactaccgtaccgcgcgcggcgttaatcagcagcgaacccggcttcatcagggctatctcttttgcgcccatcatgtttttggtggaggcgttttcaggtacgtgcagactgaccacatcgctcatattcagcaattcagacaggtgctgcacctgagttgcattaccgagcggcagtttattttcaatatcatagaaatagatatgcatccccagcgattccgccagaatgcccaactgcgttccgatatggccgtaaccgataatgccaagctttttaccgcgtgcttcgaacgatcccgccgccagtttattccatacgccgcggtgcgctttggcgttcgcttccggcacgccgcgcagcagcagcaatagctcgccaatcaccagctccgccacggaacgggtattcgagaatggcgcgttaaagaccggaataccgcgttttgccgccgcatttaaatccacctggttggtgccgatgcaaaaacagccaatcgccaccagcttctctgcggcgttaatcacttcttctgtcagatgagtacgggatcgcagaccgatgaagtgggcatcgcggatggacgctttcaactgttcagcgtccagcgcgcccttgtgatattcaatgttggtgtaacctgccgcacgaaggctttccagcgccttttgatgcaccccttcaaccagcagaaatttaattttatctttctccagcgatacctttgccatttccccgatcctgtctttttttgccatctgatgttgtgtgtggatttgcatccgtccttcaacatatcaaaaaaaattatcacggcaatatgaacgtttgcgccaacgccgtgaaggaatcgcatacagcgggaaatagcagatgaaaataccgggaataacttttctttggagggatcggcagggcaaacgattaaacgtgatacatgtcaccaaatttgccctgaccgaattctttacgcggcaggaaatacgcctggcgggatcattttacgatggttttcaccccgtccggcgtgccgatcagtgcgacatcggcgccacggttggcgaacaaccctacggtcacgacgcccggaatcgcgttaatggcgttttccagcgcgatgggatcaaggatttccataccataaacatccagaatcacgttgccgttatccgtgaccacgttctgacggtactccggacgcccgcccagcttcaccagttgacgagcaaccgcgctgcgcgccatcggaatcacttcgaccggcaacgggaatttgccaagaatatccacctgtttagaggcatccgcaatacagataaatttctccgccacggaagcaataattttctcacgggttaatgccgcgccgccgcctttgatcatctgcatatgaccgttgatttcgtccgcgccatcgacatagatacccaggctatccacttcgttgagatcaaacacatgaataccgaggcctttgagtttttcagtcgaggcgtccgagctggagaccgcgccttcaatctggcctttcattgtgcccagcgcatcaataaagtgtgcggccgttgagcctgtaccaacgcccacaatggtgccgggctgtacatactgaagtgccgcccatcctaccgcttttttcagttcatcctgcgtcatagatcgtttcgcctgtggtgtgaaaatacagccgcattatagaacattgtcgggaaaaatctccgtgtccgtacacaggctacggatttcatctgtaccgacggcaaatttatgtcatagtgcggaaaaaataacaggagcatgacacaacaatgaaacgtccggactacagaacactacaggcgctggatgccgttatacgtgaacgaggattcgagcgcgccgcccagaagctgtgcatcacgcaatccgccgtctcacagcgcataaaacagcttgagaatatgttcggacaacctttgttggtgcgtaccgttcctcctcgccccacggagcaagggcaaaaattactggctctgctgcgtcaggttgaactgctggaagaagagtggctgggcgatgaacaaaccggctctacgccgctactgctgtcgctggcggttaacgccgacagtctggcgacctggctgcttccggcgctggcgccagtactggcggactcccctatccgtctcaatttacaggtggaagatgaaacgcgcacgcaagaacgtctgcgtcgcggcgaggtggtgggcgcggtgagtattcagcatcaggcgctgcccagttgcctggtagacaaactgggcgcgctcgactatctgtttgtcgcgtcaaagccgtttgccgagcgctattttcccaatggcgttacccggtcgtcgctgctgaaagcgcccgccgtcgcgttcgaccatctggatgatatgcatcaggcttttttgcaacagaatttcgatctaccgcccggcagcgtgccgtgccatatcgttaattcatccgaagcgtttgtacagcttgcgcgtcagggcacggcctgctgcatgatccctcacctgcagattgagaaagagctggaaagcggcgagttgatcaacttaacgcctggcttgctacaacgccggatgctttactggcaccgctttgccccggaaagccggatgatgcgcaaagtgaccgacgcgctgctggagtacgggcacaaggtgctgcgtcaggattagcctctctatgaatgccggatggcggcgtgaacgtcttatccggcctgcatgacccattattcccccgtcgcttctttgaaattgatcacaaaatcattgcgttcaggcggcaaaaaacgacgcgccattggctattttttgctggcggcaaggcgactcaaaacgctcaccgtattatcaaatcttcatttcattgcgtaatacggagcaaaaaatgagaacaccgggagaaaacgcggcctggaagcgcccaggccgggcgagattactgcgtgctggcggccgttgtcgacgtctgccctgttccaggttcaagctggaataccacatcgacctgatcgtcgaactgaatagtcggctgctcgtaagtttcctgcgcggataccggcgcagcatctgcggctttcatcattcgcaccaccggactcggctgataattagagacatggtaacgaacgctgtaaaccggccccaatttgctgttaaaaccggctgccagcgcttgcgcctgatgaatcgcgtcatcaatggcggctttgcgggccttgtctttataggcgtccggttgcgccacgcccagcgataccgaacgaatctcgttcagacccgccttcagcgcgccgtccagcagcgaattgagtttatctaactgacgcagcgtcacctcaacggttcgcaccgcgcgataccctttcagaatgcttttaccgttttggtaatcataatccggctgcgtgcgcagattcgccgcgctaatgtcttttttcgcaatctgattttgctcaaggaaggaaagatattgcgccacgcgctcatcggcctgcttcttcgccgtcgccgcatccttcgccgcgacgttcacttcaatcgctaaggtggcgatatcaggcacagcatcgacgcttgctgtaccggaagtcacgatgtgcgggccttccggcaattcgcttgcctgcgccgacattgcacttaaacccactaatgccgccagggccatcactttgaacttcacagtctctcctccatattgcagtcattgccctgatatacagggcgcatgcaggcaagcttagcggatatcggtctgttgtccatcagacaacgcttagttgaaaagcgcgtgcatatgcgcgacgccttcccgcgccagttggaaggcgataagccacatcaccacccctaccagaatgttgataatgcgttgagctttcgccgtacgcagtcgaggcgcaagccaggccgccagtagcgctaacccaaaaaaccataagaacgacgcgctaatcgtgccgagagcaaaccagcgctttggctccatagccagttgtccgccgagactgcccaacacgacaaacgtatccagataaacgtgcggattcagccaggttaccgccagcatcgtagcaataattttccagcgcccctgcttcataacctcggcgctggccagctccagattactgctcattgccgttttcagcgcgccaaaaccgtaccataacaagaacgcaaccccgccccatgtgaccagcgccagcagccacggcgactgcatcagcaacgcgctaccgccaaaaataccggcgctaatcaggactaaatcacttaacgcgcaaagcagcgctatcatgaggtggtactggcgacgaattccctgattcatcacaaacgcattttgcgggccaagcggaaggatcatggcggcgccaagggcaaccccttgaaaataataagatatcacgttaactaccctgagctgtttttcttaaaggcagactatagcgcgggaatattattagcggaaattgataattttaatcactaataagaaaagctaataaagagactgaataacggatggcggctacgcttatccgctcaataaccagagaatactggaggcggataagcgcagcgccggcaggcagcacgggaggaaaattactccgcggcgttatctttcacgcgtttaaaattgacgtccatctgcgggtacgggaagctaataccagcggcgtcgaattcacgtttaatacgttccagcacgtcccaatagacattttgcaggtcgctgcttttactccagacacgcaccacaaaattaattgatgaggcgcccagctcattcaaacgcaccgtcatttcgcgatcttttaaaatacgatcgtcggactcgataatcgtcgttagcagctgtttcacctgatcgatatccgaatcgtaggccaccccaataatgaattcgttacggcgaaccggctcacgagaatagttgatgatatttcccgcgataattttgccattcggaatcacaataattttgccgtctaccgcgcgcattgtcgtggaaaagatttgcacgttcagtaccgtaccggcaacgccgcccaaatcgacatactcaccggcgcggaacggacggaacataaccagcaataccccagccgcaaggttagaaagcgatccctgtaatgccaggccaacggctaaaccagcggcgcccagtacggcaataaccgaggcggtttgaacccccacgcgacccagagccgcaatcagcgtaaaagcgataaccccatagcgcaccagcgcagaaagaaagtcggctactgtcgcatcaatatgacgcgcacgcatcagacgatttaccgtattggagatcacgcgcgctacaatcaagccgatgatgataatagcgatagccgcaacaatattcacagcatagctgagcaataacgcctggttgcgtaccagccaggtgcccgcaccatttatgctgtcgacaacattcaaatcttccattcaatattccttggtcatagcaaaacaagcaaatgagatcattctcacgaaaagaactttttaaaggtaaacaaaaacagaggaatatgccatttttcggcatcatcccaaaaaaggcaggtacactgtgagttggccggatgaaagcgctaactaacgccgctctccggaaataacgataataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcacaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaaatggcttcccgagggaagccatttcaatcagcagactatattacagaacgtcaatcgcgttcagttctttaaatgctttttccagacgagcgatcatcgaagtctggccagcacgcagccatacgcgcgggtcatagtatttcttgttcggctgatcttcgcctttcgggttgcccagctgaccttgcagatacgcttcgttttctttgtagtaattcagaacaccttcccaggttgcccattgggtatcggtatcgatgttcattttcactacgccgtagcttacggagtctttgatttcctgagcagtagaaccggaaccgccgtggaaaacgaagttcaggctgttgtgcggcaggttgtgtttcttagaaacatagtcctgagaatcacgcaggatggtcggggtcagaaccacgttacccggcttgtaaacgccgtgtacgttaccgaaggaagcggcaatggtgaaacgcgggctgattttgctcagctcagtgtacgcgtaatcaacatcttccggctgggtgtacagagcagaagcgtccatgtggctgttgtccacgccgtcttcttcgccaccggtgcaacccagttcgatttccagagtcatgccaattttggacatgcgcgccaggtatttggagcagatttcgatgttttcgtgcagagactcttcagacaggtcaatcatgtgagaagagaacagcggtttaccggtagccgcgaagtgtttttcacccgcgtccagcagaccgtcgatccacggcagcagtttcttcgcgcagtggtcagtgtgcaggataaccggcacgccgtagtgttcagccatctggtgaacgtgatgcgcgccagagatagcgcccaggattgccgcgccctgaggtacgtcagttttcacgcctttacccgcgatgaaggacgcgccgccgttggaaaactgaacgatgaccggtgctttaacttttgcagcggtttccagaacagcgttgatggaatcagtgcccacgcagttaactgccggcagagcaaaattgttttcttttgctacctggaacactttctgtacgtcatcaccagtgatcacgcctggttttacgaaatcaaaaattttagacatgtttcgttgtcctgtatcgtcgggctttgggaaaaaacacgggccgccctgaatgtcagatcggcgataaatcaacgggcaggaatccctgcccgtaacgattacttcttagcgcgctcttcgagcatcgctacggctggcagaactttaccttccacgaattcgaggaatgcgccgccgccagtagaaatgtaggaaattttgtcagcaatgccgaacaggtcgattgccgccagggtgtcgccgccgccagcgatggaaaacgcttcgctatcagcgatggcattcgccacgatttcagtccctttacggaagttcgggaactcaaacacgccaaccgggccgttccacagaatggttttggcattcttgaggatttcagccagctgctgagcggaagcatcgccgatatccaggatctgctcgtcttctttcacgtcgttaacggatttcagagtcgctggtgcggtttcggagaactcggtggcaacgcgaacatcggtcggaaccgggatatcgcaagtggtcagcagacgttttgcttcgtcaaccaggtcagcttcgtacagggatttaccgacgctgtggccctgagcggcaacgaaggtgttggcgataccgccgccgacaatcagctggtcagcgattttagacagggaatccagaacagtcagtttggtagatactttagaaccaccaacgatagccaccatcggacgagccggctctttcagcgctttacccagtgcatccagttcagcggccagcagcgggcctgcgcacgcgacgtcagcaaatttgccgataccgtgggtagaagcctgcgcgcggtgcgcagtaccaaaggcgtccatcacaaatacgtcacacagggcggcatattttttagacagcgcttcgtcgtctttcttttcgcctttgttaaagcgaacgttttccagaaccaccagctcaccttcggccacgtcaacgccgtccaggtaatctttgaccaggcgaaccgggttagacagtttgtctttcaggtagttaacaaccggcagcagagagaattcttcgttgtactcgccttcggtaggacgacccaggtgggaagttaccatcactttcgcgccctgtttcagagccagttcgatggtcggcagagaagcgcggatacgcgcgtcgctggtcactttcccttctttaacaggtacgttcagatccgcacggataaaaacgcgtttcccggccagatccagatcggtcatcttaattacagacatggtgaatcctctcaatgatgcttaaagttttgtcgacgctgacgcgtcgagcctgaaaccaactgcggccatcgctaacgtggtgtcgagcatcctgttagcaaagccccattcattatcgcaccagaccagcgtcttgatcaggtgggcgccactgacccgggtttgcgtgccatcaacaatggcgctgtgcgggtcgtggttaaaatctatcgagaccaacggtgattccgtatagtcaactataccatgaaatgcaccttgtgctgctttttgcagcaactggttgacttcactagcttttactggttttttcaccgttacgcttaaatcgatcgccgtcacattaatggttggaacgcgcaccgcaatcgcctcaaaacggtcgttaaactgcgggaatatacgcgtaatgcctgccgccagttttgtatctaccgggataatcgactggctggccgcgcgcgtgcgccgtagatcggagtgatacgcgtcgatcacctgctgatcgttcatcgcggagtggatcgtcgtgacggtaccagactcgatgccgtaagcatcatccaacaatttaatgacgggaattatgcaattcgtggtacaggacgcgtttgagacaatacgatgttccgcacgcagttggttctggttcacgccaaaaacgacggtggcgtcaagatcgttgctgcccggatgagaaaagagcactttcttcgcgccagcggcaatatgcgcctcgccatgctcccggttgccatatacgcccgtacaatccaacacgacatccacgcccagttcgcgccacggcagatccgccagcgttcgttcatgcagaatacgaatgacatcgtcgccgacaaaaagctgctcgcgctcgtggcgaacctcccatgcaaaacgcccgtggctggtatcgtatttcaacaaatgcgccatgcctgcggcatccgccagctcgttgatggccaccacggtaatttccgcccgacgtccggattcatacaaagcacgaaccacgttacgcccgatgcgaccaaagccattaatcgctatgcgtacggtcataggtctcctgcaaggctatcccgattcagatgaggctgacagagtaatgcagcttatcgtcgagtaaaacctcacctgtcgcaaactgcgactgattggttaattgtcgaacatttaattaactgaaacgcttcagctagaataagcgaaacggggaataaaaggaatgtttgtccagtcgaagaagacagttatctgacctgcatcacatttcatggccgcttacgctgcaatttattccatatttaagaatcaccagtacatccgtcagatcttttcatcgtcgcgtcacaaatactgatttatatcagaaagcgctgtcgccagcgtctatattatcagcgccacgtccgagtctcggagtcctgtaacgatgactgtatctcaccacaatgcctctacagcgcgcttttacgcgcttcgtctgcttcccggccaggaagtgttttcccaattacacgcctttgtgcaacagaaccaattacatgccgcctggattgcagggtgtaccggcagtctgaccgacgttgcgctgcgttatgccgggcaagaagcgaccacatcgctcaccggcacgtttgaagttatctcgctaaacggcacgcttgaattgaccggcgagcatctgcatctcgcggtatcggatccctacggggccatgctcggcggccatatgatgccagggtgtaccgtgcgtaccacgctggagctggttatcggcgagctgccagcgctgacgttcagccgtcaaccgtgcgccatttccggttatgacgaactgcatatttcttcccgttaattgacgactctttaagaggtactttatggcgcgtcgcccgttttccagccagtctctggtgctgattgtcatcgctattgccatcaatatgattggcggacagcttattagcatgttgaagctgcctatttttctcgactcgatcggcaccttaattagcgcggtactgttagggccgttcatcggcatgttgactgggcttctgaccaacttgctgtgggggctgcttaccgaccctatcgctgccgcgtttgccccggtagcgatggttatcggtctggtcgccgggtggctggcgcgcgcaggctggtttcgtaccctgcccaaagtgatcgtcagcggggtcgtcattacgttggcggtgacgctggtcgccgtaccgcttcgtaccgcgctttttggcggcgttaccggtagcggcgctgatttgttcgtcgcctggatgcattcaatgggccaaaacctggtggagtcagtcgcgattaccgtcataggcgctaatctggtcgataaaattctgacggcgatcatcgtttgggtgctgctgcgtcagctaccgttacgtacgacacggcattttcctgcgatgtcagccgtacgctaaatgcatccgtttacctcgttaaccttatgggcgttggcggcctgcaccacgctgctactccctgcgcagaccgtgttcccggtttatagcgcggcggccttcctctgtctgctggcgctgaaatcaacgcggcggcgggcgaagtatgtcgcctggctgatgctgtctttagggtttgggctatggctggtacatggcggttggctaacggaatggataagcgggcagcctcgcgatccgcagcgctgggtatatgccgttacgctatggctacgtctgctggcgatcgtgtcgacgtcgcagctatggatgcagtatgtgccggttcagcggtttattcgcgccctgttcgcttcacgtctgccacccggcatcgcttacctgttcgctggcccgctgctggtcgtcgaacagctcaaacgacaactgacgatcgttcatgaagcccagcgcgcgcgcggcgtaccgctggatgaaggctggtatcagcggctacgggcaatgcctgcgctgatcgtgccgcttacgcaaaatgcgcttaacgatctgacaatacgcggcgcggcgttggatatgcgggggtttcggctgcatcgagcccgaaccacgctgtgggcgccgaaagatagcatgttacaacgggttgcgcggtatggcatggtactgctaatactggcggaagcgggagtatggatatggttacgttagagcagtttcgttatcttccgtccgatgcgacacgcccgccggcatgttttgatttccactattcaacacccggaatagtggcgatagtcggcgataacggcagcggaaaaagtacgctggcgcaactgatggctggctggtatccggattatctccccggcgatattgacggcacaggcctactgcttggcgtacctatcgggcggctcccgctggtagaacagtcgcccaccatccacctggtgcagcaatcgccttatttacagctttccggctgtacctttagcgtagaggaagaggtggcgtttggcccggagaatctcggcctccatgaagcggaaattctacggcgcattgacgaggcgctgactctgacaaactgccagtcgttacgccatcgccatcccggcacgctctccggcggcgaaacgcagcgggtagtgattgccagcgcgcttgccatgcagcccagattattagttcttgatgaagccttcagtcggctgacgtcagcggccaccgggacactgctggaacggttacaacagtgggcgctggaacgtcattctctcattgtgctttttgagcgtaatcatttcccctttctgacgcgatgccagcgggtatggcaattgcgcaacggagcgctaaccccattatgttgacgttaaatcaggtcgcttatcgctggccagatgccgcagccgactgtctgcacgccatctcgcttgaacttcgtgacggcgaatggctggcgttgaccggcgataacggcgcgggaaaatcaacgctgttacggattatggccggcctgctttcccccacttccggctcggtaacgcttaatggagagccgattgcgcagcttaaaaatcgtcaacgcgccgccgctatcggcgtactctttcaggaagcggaaaaccagattttccacagcaatgtcgcacaagaggtcgcttttgggctgaaactacagcgcttatcggcggaggatatttcacggcgcacgcaggccgcgctgcggttatgccagctaacggacgtcgccgaggcgcccccgcttgatctgcacgccgcgcagcgccggatggtggcggtcgccagtctggaggcgatggcgccgccggtgttattgctggatgaacccagccgggattttgacgcccactggctaaccgtatttgaacactggctggcgacatgccgggcacggggaaccagcgtcgtggcgattagccatgacgctgcgtttacccggcgtcatttttcccgggtggtacggctggaaaacggcaggttgtcaaagggggaataaatatcctccggcatagccggaggtttttctgatgcgcctgtaaggctctcttaccagccgcgccctaacaggcgcatacgatctgacatttgcatcaaacttcgttacttacggcccgtaaacgggctgcccggatacgggatcgataattgctcacccattttatcctcttcaagctggtgctttatgtagtcctgtatcttcgccgtattcttacccaccgtatcgacatagtaccctctgcaccagaactccctgttcctgtatttgaattttagatccccaaactgctcgtaaagcatcagactacttttacccttcagatatcccatgaaactcgacacactcatcttcggcgggatctccagaagcatgtgaatatgatctgcgcaacattctgcttccagaattcgtacgtttttccattcacacaattttcttaatatgctgcctactgccctacgcttctctccatagaacgcttgtcttcggtatttgggcgcgaaaactatgtgatatttacagttccatcgggtgtgcgctaagctcttttcgtcccccattgggacccccttttgatttcttgttgaacttttgcagttgccagaccgcaagatgttttaacaaatcaaaaggggttttaataactggcttaaagctgaaagctttccggaacccccagcctagctgggggttttccatagacaaaaaacgggtcgccgaagcgacccgttttatgccgtattaaggattacagcagcgctttcgctttggcgatcacgttgtccaccgtgaagccaaactcttcaaacagcagctctgccggggcggattcaccgaaggtggtcatcccgacaatagcgccgttcaggccgacgtatttgaaccagtagtcagcgatacccgcttcaatcgccacacgcgcagagaccgctttcggcagcacggattcacggtaggccgcatcctgcttgtcgaacgcgtcggtggacggcatggaaaccacgcgcgccttcacgccttcggcagtcagtttttcgtaggcggcaaccgccagctcaacctcagaaccggtcgcaatgaagataatctgcggctggcccgcacaatctttcagtacgtaaccaccgcgggcgatattcgccagttgctcttcagtacgctcctgctgcgccaggttctgacgggacagaatcagcgcggttgggccatcctgacgctctatgccatatttccacgccaccgcggattccacctggtcgcacggacgccatgtggacatgttcggcgttacgcgcaggcttgccacctgctcgaccggctggtgcgtcgggccatcttcgcccagaccgatggagtcgtgggtatagaccatcacctgacgctgtttcatcaacgctgccatacgcactgcgttacgggcatattcgacgaacatcaggaaggtggaggtgtacggcaggaaaccgccgtgcagggcgataccgttggcgatagcggtcataccgaattcgcgcacaccgtaatgaatgtagttacctgcggcatcttcgttaatcgctttcgaaccggaccacagggtcaggttagacggtgccaggtcagcggagccgccgaggaattccggcaacagcggaccgaaggcttcgatggcattctgggacgctttacggctggcgattttggatggattcgcctgcagtttagcgatgaactcattcgctttcgcattgaagtcagccggcatgtcgcctttcatacgacgagtgaattcagcagcttcctgcgggaaggctttctcataagccgcgaatttctcattccatgcagactctttcgcctggccggcttctttcgcatcccactgggcgtagatttcagacgggatttcgaacggcgcgtatttccagcccaactgttcgcgggtcagcgcgatttccgcgtcgcccagcggcgcgccgtgggaatcgtgggtaccctgtttgttcggcgaaccgaagccgatgatggttttgcacatcagcagggacggtttgtcagtcacggcgcgagcttcttccgtggcacgtttaatggcgtcggcatcgtgaccgtcaatgccacggataacgtgccagccgtaggcttcaaaacgtttcgcggtgtcatcggtgaaccagccttcaacatgaccatcgatagagataccgttgtcatcatagaacgcgatcagtttgcccagtttcagagtaccagccagagagcacacttcgtgagaaatgccttccatcatgcagccgtcgcccataaagacgtaggtgaagtggtcaacgatgtcgtggccaggacggttaaactgcgccgccagagttttctcggcaatcgccatcccgacggcgttggcaataccctgccccagcgggccggtagtggtttcaacgccagcggtgtagcccacttccgggtgaccaggggtttttgaatgtagctgacggaaattctgcagttcggacatcggcaggtcataaccggtgaggtgcagcaggctgtaaatcagcattgagccgtggccattggacagcacgaagcggtcgcggtcggcccaagacgggttggtcgggttgtggttcaggaaatcacgccacaggacttcggcaatgtcagccatacccatcggggcacccgggtgaccggatttggctttctgtactgcgtccatgctcagcgcacgaatagcattggcaagctctttacgtgaggacattttgactccagatcggatgttgaaaggccatgcccgtaacgacttgacgacagcgcgttttgggctacgccggaaaatttgccaacaatttaccccaagccgcgcgtcatgtacatggaacatccttttaccgcttcagaaatctccggatcgtgctcgcatgttgcgcaattagctaacttgcctgccacgcttttctttatacttaacccaggcgctaattcatctgcaacgggcgcatttcaaaataatattaattcgtatggaagagaaaaatgaaaattcgcgctttactgcttgctttgggcatggcgacggtgctgaccggttgccagaatatggactctaatggactgctttcttcgggcgctgaagcttttcaggcctatacgttaagcgatgcgcaggtaaaagcgttgagcgatcaatcctgtcaagagctcgacagcaaagcgaaaatcgcgccggcgagcagcgaatacactaaacgactggcaaaaattgccgccgcgctgggggataacattaacggccagccggtgaactataaagtttacgagacgaaagacgtcaacgcgtttgccatggcgaacggttgtatccgcgtctacagcggactgatggatatgatgaccgacaacgaagttgaagccgtgatcggtcatgaaatgggccatgtcgctctgggtcatgtaaagaaagggatgcaggtcgcgctgggcactaacgccgtgcgcgttgcggcggcatcggcaggaggcgttgtcggcagcctgtcgcaatcacagcttggcgatcttggcgaaaaactggtgaactcgcagttctctcagcgtcaggagtccgaagcggatgattattcttacgatctgttgcgcaaacgcggtatcagtccggcaggactcgccaccagctttgagaaactggcaaaactggaagcgggtcgtcaaagctcaatgttcgacgatcacccggcgtccgccgcacgcgcacagcatgtgcgcgatcgtatgagcgcggacgggatcaaataatccccgaacagtgccggatggcggcgtgaacgccttatccggcctacacaggcccggtaagcgtaggccggataagcgcagtgccatccggcaaaacaacttactcgcccttcttcgccgcctggatatagagcatttctaatgccagcgtcgcggccgccagagcggtgatctccgactgatcgtaagccggcgcgacttccactacatccataccgacaatgttcagatctttcagaccacgtaccagcttaatggcgcgatcggaggtcaaaccaccgatcaccggcgtaccggtgccaggcgcaaacgccgggtccagacagtcgatatcaaaggtcagatagaccggcatatcgccgacgatctgtttcacctgagcgagaatatcatccacgccgcgatcgttgacctggcaggcatccagcacggtaaagccattgtctttgtcaaactcagtgcgaataccgatctgtaccgaatgatgcggatcgatcaggccttctttcggcgcggtgtagaacatcgtgccgtgatcgaattcgcagccgttagcgtaggtatcggtatgcgcgtcaaaatgtaccagcgccattttgccaaaatgtttcgcgtgggcgcgcagcagcggcagcgtgacgaagtggtcgccgccgaaagagagcatacgcttgcctgcagacagcagtttttcagcgtgcgcctgtaatttttcgctcatttcacgggcatcgccaaacgcatacaccagatcgccgcagtccacgacgttcaggcgctcgcgcatgtcaaaattccacgggaaacggtgatgttcccaggcgaggttggtcgacacctgacggatcgccgccgggccatgacggccgccagcgcgaccggacgttgccatatcaaacggtacgccagtgatcacccagtcggcatcgctgtcatacggctggaagttcattggcagacgtaaaaaaccaaacgcattagaaaccagtgagttatcgtactgatgacctaaagtgctcatgtcctgacctcttttagagtcgttgcattaaaacagatgaaaaaaatcccctccgcgtcgttaaacccgacgaggaagggattgatttgtaaatcgctattgcagcgaattatcgccgttaattcatacgggttcaagtgagtatagcattctgccgggtggcggctttaccttatccagcctgcattcgtaggcccggtaagcgcagcgccgccgggcatcaacggctactcatcttcaagataagtataaccgtacagtcccgcttcaaattcctcaaggaactgctgctgcaacgcatcgtccagatccgtctgttttacctggtcgcggaaatgcgttaatagcgttttcggatccagttgcacatattgcagcatatccgcaacggtatcgccttcgtccgacaactcaacctcgacactaccatccgggaagacaaacacgtcaaccgcttcagtatcgccaaacaggttgtgcatgttaccgaggatctcctgataggcgccgaccataaagaagccgagcatcggcggattctctggatcgtattccggcatcggcatcgtcgtggcgataccgtcgccatcgatatagtggtcgatagcgccatcggaatcacaggtaatatccagcagcacggcacgacgttccggtacctgatctaacccttccagcggcagcaccggaaagagctgatcgattccccacgcgtccggcatcgactggaacagcgagaagttgacgtacattttgtccgccatccgctcttgcagttcgtcgataatcgggcgatgcgcacggttttgcgggtccagttgcttctgcacttcatggcacatgctgagataaagttgctccgcccaggcgcgctcctgcaaactaaacgcgccggaagagtagccgatatgaatatcgtgcagatccatttggctatcatgcagccattcacgcagcgagcggcgggtgccaggcttatgcatctcctgccaggtttcccacagattttgcagcgcgcgcggcgcatcttcagcaggggcggtcggatccgtgtattcgttacgctccacgccgataatgttagagaccagtaccgtatggtgcgcagtgacggcgcgcccagactcggtaatcaccgtcggatgcggtaaaccatgctcttcgcaggcatcgccaatcgcccagatgatgttattggcatattcgttcaggccatagttcaccgaacagtcggactgcgagcgggtaccttcataatccacgcccagaccgccgcccacgtcgaagcactggatattaacgcccagcttatgcagctcaacatagaaacgcgcggactcgcgcacgccggtcgcgatatcgcgaatgttcgccatctgcgatcccaggtggaagtgcaacagttgcagactgtccagacgcccagcgtcacgcagggtctccaccagttgcagcacctgcgtcgccgccaggccgaattttgatttttcgccgccggaggattgccacttaccggacccctgagaggccagacgcgcacgcacgcccaggcgaggaaccacgttcaggcgctcggcctcttccagcacaatcgcgatttcagacatcttttcgatgaccagataaaccttatggcccatcttctcgccaatcagcgccagccgaatatattcacggtctttataaccattacagacgatcacgctacgggtcatgccggcatgcgccagcaccgccatcaattccgctttcgaccccgcttccagccccaacggttcaccggaatggataagggactcgatcacgcggcgatgctgattgaccttaatcggataaacgaggaagtagtcgccgttataaccgtaagattcacgcgcacgcttaaacgccgcgttaattgaacgcaaacggtgttgcaggatctgcgggaagcagaacagcgccggcagacgctgaccttgcgcttcgcgcgctttcaccagtttggcaagatcgacacgcgcttccggtacgtcgggatcggggcatacgctaatatggcccagctcgttgacgtcgtagtagttattgccccaccaggcaatattgtaagtgcgcagcatcttgctggcttcctgggagctcattgcaacctcctgcatggagcgtagtacaccctgttcgcctgctgacgaaggcgaacccatagacatgtcgtcagacatagcgaacctcaatttttattagcaagtgtaaaacagttgactactatcgcaatccgaagacgcgataacaacccatagacaagcggattttccagcagatagcgctgatgctccgcctgcgcgaccggtttctttttcatatcattgtaaacacgtaaccgaactcacagataacggttcggcgaaaccacgagaaaactcttgcgttaacaagagcgcccttgttcagtcttcagcgccattgccggctctggaatcctgagaagcgccgagatgggtataacatcggcaggtatgcaaagcagagatgcagattgcgggagacatgcgcgcaccagaacgatgcgacagattcagcagaatacaacggttcattatctcgtatcacctccacggccgcctcgtaagacgaacccacaagccaaagcaacgttttaacccggctggaagtggcgacacgaagaaaacgtcgtgtgcttttgtatgagccgcgcgtcgcgttttatacccagaacgcagaaaaaaagcaaagcataaatgcgcataatgtcagcattatcagaaacgtttaccgcctgattttgaccgacattgcgacggccttcaaaaaaagctggaaattgggcgaagaagtgacctaaaatagccgtccagatgttaatccatccatactgattaacactcagactgccagtgttagtaaccttcagactcatggtagaatcttctgtcatgactattccgcacaacagtttgagctaactaaattctccttaggtgaaattaaatatggcaaaacacctttttacgtctgagtccgtatcagaagggcatcctgacaaaatcgcagaccaaatctctgatgccgtgttggacgctatcctgcaacaggatccgaaagcacgcgtcgcctgtgaaacctacgttaaaaccggcatggttttagttggcggtgagatcaccaccagcgcctgggtcgatatcgaagagattacccgtaatacggtgcgcgaaattggctatgtgcattccgacatgggctttgacgccaactcttgcgcggtactgagcgcaattggcaaacagtctccggatatcaaccagggcgttgaccgcgcagacccgctggaacaaggcgcgggcgaccagggcctgatgtttggctacgcgacaaatgaaaccgacgtactgatgcctgcgccaatcacctacgcgcaccgtctggtacagcgtcaggctgaagtgcgtaaaaatggcaccctgccatggttgcgtccggatgcaaaaagccaggtcactttccagtatgacgacggcaaaatcgtcggtatcgacgccgtggttctctctacgcagcacgcagaagatatcgaccaaaaatcgctgcaagaagcggtgatggaagagatcatcaaacccattctgccgtctgaatggttaaatacgtccactaagttttttatcaacccaaccgggcgttttgttatcggcggcccgatgggcgattgtggtctgaccggtcgtaagatcatcgttgatacctacggcggtatggcgcgtcacggcggcggcgccttctccggtaaagatccgtctaaagttgaccgttctgcagcttacgctgcgcgttatgtcgcgaaaaacatcgtggcggcaggtctggcggatcgctgtgaaatccaggtctcctacgctatcggcgtagcggagccgacgtccatcatggtggaaacgttcggtactgaaaaagtgcctgctgaacagttgattctgctggtgcgcgaattcttcgacctgcgcccgtacggcttgattcagatgctggatctgctgcacccgatctacaaagaaactgcggcttacggccacttcggtcgcgaaaacttcccatgggaaaaaaccgacaaagcgcaactgctgcgcgatgctgccggtctgaaataatcgcccgcgcctgacgctgtttttcagtcaggtaaaccataccgtacttatcaaggccagcgccctgctggcctttatcattgctgatacacgcaacgttattagatgttccagcgtgtatttatactgacctttttgtgatgcgcagcacaatccgctctcctctttcgtttcttcgactacacttttcatcattcagtttcagcagctatgaaagcggttacattcattttcattgagaactgaccacctcactgtcggtatgctaactctgcgatgaaaatgttacatagtttttcagctttgtctgaataccaggcgattgatagggttataagattattaaaactattatttttcagataattaaataatcaccgagataaatagtagtgtaaacgattacaccattgtgattagcctcacatctttttacggcgtactcacctactcttaacatcgataaaattgctaacccaaccggagggcataatgcctgacaataaaaaacaagggcgttccaacaaggccatgacattttttgtctgctttcttgcagccctggcaggattactttttggcctggatatcggcgttatcgccggtgctttacccttcattaccgacgagtttcagattaccgcacacactcaggaatgggtggtcagctccatgatgtttggcgcggccgtcggcgctgtcggcagcggctggctctcctttaagctgggtcgtaaaaaaagcctgatgatcggcgctatcctgttcgtcgccggttcgctgttctccgctgcggcgcctaacgttgaagtcctgattatttctcgcgtgctgctgggtctggccgtcggcgtcgcttcctacactgcaccgttgtacctgtccgagatcgcgccggaaaaaattcgcggcagtatgatctcaatgtaccaactcatgatcaccatcgggattctgggcgcttatctgtccgataccgcgttcagctacagcggcgcatggcgctggatgctcggcgtgatcatcatcccggccattctgctgctgatcggcgtcttcttcctgccggacagcccgcgctggtttgcggcgaaacgccgtttccatgatgctgaacgcgtcctgttgcgcctgcgtgacaccagtgcggaagcaaaacgtgagctcgatgaaattcgcgaaagtttgcaggttaaacagagcggttgggcgctgttcaaagagaacagcaacttccgccgcgccgtgtttcttggcattttgttgcaggtaatgcagcaatttaccgggatgaacgtcatcatgtattacgcgccgaaaatcttcgaactggcggggtacacgaataccacggagcagatgtggggcaccgttattgttggtctgactaacgtgctggcaaccttcatcgctatcggcctggttgaccgctggggccgcaagccgaccctgacgctgggcttcctggtcatggcgattggtatggggattctgggtacgatgatgcacatcggcatccattcaccgtctgcgcaatacttcgctatcgctatgctgctgatgttcatcattggatttgcgatgagcgctggtccgctgatttgggtactgcgctccgaaatccagccgctcaaaggccgcgatttcggcatcacctgctccaccgcgaccaactggatcgccaatatgatcgtcggcgcaacgttcctgaccatgctgaacaatctgggtaacgccaacaccttctgggtctacgctggcctgaacgtgctgtttatcctgctgaccctgtggctggtgccggaaaccaaacacgtttcgctggaacacattgaacgtaacctgatgaaaggtcgtaaactgcgcgaaatcggcgcccacgactaatccctccacgcttcctcctgccacaggaggaagcgtttttcttgcagtccctcttccgtcgcactattctctgccgctatgaaaacccctcgtctccctatcgctatccagcaggccgtgatgcgccgtctgcgggaaaatctcgcccaggcgaacctcaagctcgatagacattatccggagccgaaactggtgtatacgcaacgcggcacctcggcgggcaccgcctggctggagagctacgaaatccgcctcaacccggtgttactgctggaaaacatcgacacctttattgcagaggtcgtgccgcatgaactggcgcatctgttggtgtggaagcacttcggacgcaaggctccgcatggcaaggaatggaagtggatgatggaaagcgtgctgggcgttccggccagacgtactcatcaatttgcgctgcaatccgtacggcgcaatacctttccctaccattgccaatgccagcaacatcaactcaccgtccgccgtcataaccgtgtggtacgcggcgaagcggtttatcgttgcgttcactgcggcgaaccactggtcgccgggtagttccccgaaacgtccgggaactttcctgagcggactgattgcatacagacacaactttcgctacgttgcgggctcgttttgctatggagtgtgcaatgtaccgtaatttttcttttgctgctgcgttgctggccgcagcgttttcaggccaggcattggccgacggcattaacaatttttctcaggccaaagcggcgagcgtcaaagtcaatgccgacgcgcccggcagcttttactgcgggtgccaaatccgctggcagggtaaaaaaggcgtcgtagacctggagtcctgcggctataaggtgcgtaaaaacgagaatcgcgccagacgcattgagtgggagcacgttgtccccgcctggcaattcggtcatcagcgccagtgctggcaggacggcgggcgaaaaaactgcgctaaagacccggtctactgcaaaatggaaagcgatatgcataacctgcaacccgcgattggcgaagtgaatggcgatcgcggcaactttatgtatagccagtggaacggcggcgaaggtcagtacgggcagtgcgccatgaaagtggattttaaagcgaagctcgccgagccgcccgcccgcgcccgtggcgcaatcgcccgcacttatttttatatgcgcgaccaataccaactgaaactttcccgccaacaaacgcagctttttaacgtctgggataagcagtaccccgttaccgcctgggagtgcgagcgcgatgcgcgtatcgcgaaggtccagggtaatcataatccctatgtgcaacgcgcttgccaggcgcgaaagagctaacctacactagcgggattcttgttaacccatgccctggatagccaaacgccggggccatgacgcggatttttttattatgcgtattccccgcatttatcaccctgaattgttgacgtccggtacgcagatttcgttatgcgaagatgcggccaaccatattggtcgtgtactgcgcatgggagcgggacaagcgttacagctgtttgacggcagcaatcaggtattcgatgctgaaatcattagcgccagtaagaaaagcgttgaagtgcaagtgatgaaaggcgaaatcgacgatcgtgaatcgccgctacatatccatctgggccaggtgatgtcgcgcggtgaaaaaatggaatttactatccagaaatcgatcgaactaggtgtaagcctcattacgccactgttctctgagcgctgtggcgttaaactggataatgaacgtctgaacaaaaagcgccagcagtggcaaaagatcgccatcgccgcctgcgaacaatgcgggcgtaaccgggtgccggaaattcgcccgccgatggcgctggaagcctggtgcgccgagcaagattccgggctgaggctcaatcttcatccgcgcgcccatgccagcatcaacactctgccgctgccggttgaacgcgtccgactgctgatcggcccggaaggcgggctgtcggcggacgaaatcgcgatgaccgcgcgctatcagtttactgatattctgttaggacctcgcgttctgcgtactgagacaaccgcgctcaccgccattaccgcgctacaggtgcgttttggcgacttaggatgaagcgttaacggagaaaataatgatcaagctcggcatcgtgatggaccccatcgcacacatcaacatcaagaaagacaccagtttcgctatgctgctggaagcccaacgtcgtggttatgaacttcattatatggagatggccgacctttatctgattaacggcgaagcccgcgcctgcacgcgaacgttgagcgtggagcaaaattacgataaatggtacgagttcggcagcgagcaggagattaaactcgccgatctggacgtcattttgatgcgcaaagatccgccgtttgataccgagtttatttatgcaacctatattctggaacgcgctgaagaggaagggacgcttatcgtcaacaaaccgcaaagcctgcgcgactgtaatgaaaaactgtatactgcctggtttgccgacctgacgccggaaacgctggtaacgcgcaataaagcgcagctcaaagcgttttgggaaaagcacggcgatatcattatgaaaccgctggacggtatgggcggcgcgtccattttccgcgttaaggaaggcgatcctaacataggcgttatcgccgaaacgctgaccgagctaggcaaccgctactgcatggcgcagaactatctgcccgcgatcaaagatggcgataagcgcgtactggtcgtcgacggcgagccggtgccttactgcctggcgcgtattccgcagggcggcgaaacccgcggcaacctagcggctggtggtcgcggcgaaccccgtccgttgagcgaaagcgactgggaaatcgcccgccgcgttggaccaacgcttaaagccaaagggcttatttttgtcggtctggatattatcggcgaccgcttaacggaaattaacgtgaccagcccaacctgcgtgcgtgaaattgaagcggaatacccgatctctatcaccgggatgttgatggacgccatcgaagcgcgtctggcgaagtaaaagtttattgcccggtggcgtgcgcttaccgggcctgagcaatcacgccgccccggtcggataaggcggcgcgtcagcatcgccatccggcagtctattgcccgataaggccgccgtcctttggcaaaagacggcttatatgagtgacaaccgtccgctttccccacatactgaacgctgtcgtttttttgaaccaggaaacagaacctctgacaatgaatttacagcatcactttcttattgccatgcctgcgctccaggacccgattttccgccgttccgtggtgtatatttgcgagcacaaccaggacggcgctatggggattattattaataagcctttggaaaatctgcaaattgaagggattctggaaaaactaaaaattacgccggaaccgcgcgattcggcaattcgtcttgataaagccgtgatgctcggcggcccgctggcggaagatcgcggatttattctccatactccgccgtcacgtttcgcctccagcattcgtatctcagacaataccgtgattaccacctcccgcgatgtgctggaaacgttaggtacccaacaacagccttccgatgtgctggtcgcgctgggctacgcctcctgggataaaggccagcttgaacaagagttgcttgataacgcctggcttaccgcgcccgccgatctcaatattttgttcaaaacgcccattgccgagcgctggcgcgaagcggcaaaacttattggcattgatattctgaccatgcctggcgttgcggggcacgcctgatgagcgacaccttactggcctttgacttcggcacaaaaagcatcggcgttgcaataggacaacgcattaccggcaccgcccgtccgcttccggcaatcaaagcacaggacggcacgcccgactggacgctcattgaacgtttgctgaaagagtggcagccggacgaaattattgtcgggctaccgctcaatatggatggcactgaacaaccgctgacggcgcgcgcccgtaaattcgccaaccgtattcatgggcgcttcggggtaactgtcacgctacacgatgaacgactcagcaccgttgaagcacgctccggtctgtttgaacgaggtgggtatcgcgcgctgaataaaggcaaagtggactcggcctccgccgtgattatcctcgaaagctattttgaacaggggtattaaagccgtttttgtcagcaggcggataacgcggtcacggttgccaggcttactgggcaataagctggtttaatgccttcaacgcctgtaaacgcgcagccgcctccgcctcatcaatccgccacattcccgcaaaggccagcgctgcggcgtgcttgtctagcggttgcgccatagaaacttcaccatcagcgtgatgccacagcacgtatccccgctggcgctgctgcgccacatgcggtgccagattacgccactgctccggactaaaacgctgcattagcgcctcatcgctttctgccgccagtaacgccaccccaggtaccgactgccaggccaggcacatgcgaaaccccgccagcgcctgacttccctgcgcccccggcgtagagtgataaatatagataatctggtcttcccatagcacgcctaatgccaccacgatgtctctgggcgcatgtcgctcaaggataggcaacgcatgggagaacagcgctgaaccgcgaatcgcctgcgccgccaaagcatgaatgcctggcccgggtaaatagcgtcggtgctcatcctgcatcgtgagtccaatagaggccatcgtcattaacaggcgattaacgcgcgtggtattaatatccatcagccgggcaagctcgcgacatccgatagcacggtcgctggagaccagatattgcagacagcgaatgccatctatcaggctttgattcggttgtgatgacatcgttaaatgacttcgctgtggttttaacaaagctgcgattttaacgccggttcgccaggatacaagcctgtatgccgttcaatccaccgcgccagtcaacacttccccttccctacgccgccatcttcgctacagccgtccctgcgcctgacgccattgcgcgctctgggcgaatgtcatcatcccctgctgctgcccggtttgtatcacgtgggccaactgatggagtttgccttcacggatcaaattccctgtggctggcgtattaatcagtaattcaaacaacgccacgcgcccatcctgtctgtcgacctccagtttttgcgatagtacggcgcgcagactacccgccagttgactgcgtaccggttctttttcctgcgccggaaaactatccactaatctttccaccgcctgcgccgcgccgcgagtatgcagggttgccagtaccagatgccccgtttccgccgccgtcagcgccaggcgaatggtctcgctgtcacgcagctctcccagtaaaatgacatcgggatcttcacgtaacgccgcgcgcagcccggcggcaaaagtggcgcaatgctggccgatttcccgctgctgtatcaggcaacgcttgctggtgtaacggtactcaataggatcttccagcgtcaggatgtgtttatcggcatgttgattaagatgtcccaccatcgccgccagcgtagtggatttcccgcagccagtagcgccagtgaccagaatcagtccgttctcgctggcaagcagtgcgggtactatcggcggcgtctggatttccgccagatcaggacaacgctcgggcaatagccgtatcgccagcgacgttccctgttgatgtgtgaacgcactggcgcgcaggcgccgcgtgccagacagcgagacggcgaaatcaagctgaccgtgcgttcgccactgatattgttgcgcgtcattaagccaatcaagcagaagcctgtcgacatcaggcgcggtaaaaggcgcggtctccatgcgtccttgtttgcgccatcgcgcaggccaggcgttacacaggtgtagatccgagacgttatgctttacactaagcgtcacaatttcttccatattcatataaacatcctcggaaaatgaacgatatcgcgcataacctggcacacatccgggacaaaatctccgccgcggcgacgcgttgtggccgctcttcagaagaagttacgttgcttgcagtgagtaaaaccaaacctgcgagcgacatcgcagaagccattgccgccggacaacgggcatttggtgaaaattatgtacaagagggggtggaaaaaatccgccactttcaggaagcgaaagtggaaggcctgcactggcactttattggccctttacagtccaacaaaagtcggctggtggccgagcattttgactggtgtcataccatcgatcgcctgcgtatcgcctcgcggctgagcgaacagcgcccggataatctgccggcgctaaatgttctgatccaaattaatatcagcgatgaaaacagcaaatcaggcattccgctggcggaactggatgagctggccgctgcggtggctacactgccgcgtctgcggcttcgcggactgatggcgatcccggcgccagagtcagattatgtaaggcagtttgaagtcgcacgtcaaatggctgtagcatttgccgggctgaaagcgcgctaccctgacgttgataccttatctctgggtatgagcgacgatatggaagccgcgattgcggcaggtagcacaatggtgcgcatcggcaccgctatctttggtgctcgtgattacacaaaaaattaaggaaaactgaggaacgccatgaatacgttgaccttcctgctctcaacggtaattgagctgtataccatggtgctattattgcgcgtgtggatgcagtgggcccgctgtgacttttacaaccctttttcccagttcgtggtgaaaattacgcagcccatcatcggaccgctgcgtcgtattatcccgccaatggggccgatcgacagcgcttccctgctggtggcgtttattcttagcgttattaaggcgatagtgctgtttaaggtaattacgtttcaggcgattatctggattgccgcggtgcttatcttacttaaaacaatcggcctgctgatcttctgggtgctgctggtcatggctatcatgagctgggtgagccagggtcgtagcccgattgaatatgtattgattcagcttgccgagccgctgctcagcccgattcgccgtatactgcctgcgatgggcggcatcgacttctcgccgatggttctggtgctgctgctgtatgtcgttaatatggggatcgctgaagtcttacaagcgacaggcaacatgttgctgccggggctgtggatggcgctatgagtgctgtgactcgctgcgaagacggtctggtgttacggctttatattcagccgaaagccagccgcgacagtattgtgggtttacatggcgacgaggtgaaagtcgccattaccgccccgccggttgacggtcaggcaaacagccatctgaccaagtttctcggtaaacagtttcgcgtggcgaaaagtcagatcgtcatcgaaaaaggcgagctgggccgtcacaaacaggtaaaaattattcacccgcaacagatcccgccggaaattgcggcgttaactgagtaggtattccatgcaaaaagttgttctcgcaaccggcaacgccggtaaagtgcgcgagctcgcgtcgctgttaagcgattttgggcttgatgtggtagcgcaaacgaaactgggcgttgactctgcggaagaaaccggcctgacgtttattgaaaacgcgattctcaaagcgcgccatgccgctaaaatgaccggtctgcccgccattgccgatgactccggtctggccgttgacgttttaggcggcgcgccgggtatctattccgcgcgctattctggcgaaaacgcgacagatcagcaaaatctggaaaaactgctgcatactctacgagatgttccggacgacaaacgccaggcgcgattccattgtgtactggtttatttgcgtcatgccgaagatcccacaccgatagtctgtcacggtagctggcctggcgtcattactcgccaggcggccggaaatggcggatttggctatgatcccattttcttcgtaccgtctgaaggcaaaaccgccgcagaactgacccgtgaagaaaaaagcgcgatttcccaccgtggacaagcgctcaagctgctgctggatgcgttacgcaatggctaaactaccgccgctcagtctttatattcatattccctggtgtgtacaaaaatgtccatattgcgacttcaattcccatgcgttgaagggcgaggtgccgcatgacgactacgtccagcatctgttaagcgatctggatgccgacgtcgcttgggcgcaagggcgtgaagtaaagaccatttttattggcggcggtacgccaagcctgctttccgggccggcgatgcaaacgctgctggacggcgtgcgtgcgcgcctgaatctggcggcggatgcggaaattaccatggaagcgaaccccggcacggtcgaagccgaccgcttcatcgactatcagcgcgccggcgtaaaccggatctccattggcgtgcagagctttagtgagcctaagctgaaacgtcttggccgtattcacggtccacaagaggcgatgcgggcagcaagactggcaaatgggcttgggctacgcagctttaacctcgacttgatgcatggattgccggatcaaacgctggaagaggcgctgaatgatttgcgacaggcgattgcgcttaatccgccgcatctctcatggtatcaattgacgattgaacccaacactttgttcggttcgcgtccgccggttttaccggacgatgacgcgctgtgggatatctttgagcagggccaccagttattaaccgccgcgggctatcagcaatacgaaacgtcggcctatgccaaacccggttatcagtgccagcataatctgaactactggcgctttggcgactatctgggtattggctgcggcgcccacggtaaagtcaccttcccggacggcaggatcttgcgcaccaccaaaacccgtcacccacgcggttatatgcagggacgttacctggaaagccagcgtgacgtgagtgatgacgataaaccctttgagttctttatgaaccgttttcggttgctggagcgcgcgcctcgcgccgaatttgtcgactacaccgggcttacggaagcggttattcgtcagccaatcgacgaggctattgcccagggctacctgacagaatgcgagcaatactggcagattacccgtcacggtaaactgtttttaaactctcttcttgagttgtttctcgcggaataacaaggataagcctgtcgcgccagcgggtaaaatacctgatggcgcgacgcttaccgacctgtggcggttaatgcgccaccagcaagcgcattatttaataacgcctttacgacgcaaatcgtccgtatcttttttccagcgctcgtaaccgtcattaatatccatgattttcatgcggatatcactctgttgcatctgaagtttctgtaccgctatattcagcggatattgccctttctctaacgttatccagtcattctgcgcttttcgacgcagctcttctgatttcaaaaatacctgccgccgttgctcgtgtatgtctaaatctcttttctgctgaatagccgcttcattgcacggctcactctgcttacgacacgcgtctaatgctggttgatagacctctttttcgtatttctcggcatatacgctgctatcgttggcttttacataatcatcgcgctcttttaacgtctttttaaacgcctcggcgcgggtcaacggtttcccatcagcgccttttccccaatatgcgtccgcttcttttttagctaccgctattttcttatccagggcagagagttgttcttcaagaccggggatcgacgctttctgcgcacgccaggaggcttcaatgttgccaaaccgatagttaaagtcatcactgttgacgatcaggtatttatcattcgttttaatgtcgtcaatagcccggccctgatcgctggctgccatttgtaatgagtaatagctcaccgtccagccagaggctggcgtccctttgctggttaacatggcagaaaatttaacgggacgatctttggtccaggttttttcaacaaaataataatccgccgccataccaacgccggtatacatatcttcacgggaagaaatatccccttcggcagaccaggtggcctgattgcccgtcgaatcaagattttttaaggtaatggaatccagtttaagtatgccgtggtactgcttactaaactgttcttttaagatgttatcggagggttgagcaacctctgcccaactatagcctgaaatcagggcaaacagcgctgcgccagcaatccattgtcgaaccacttgtggacctcccgtccagagacatgacgcccacaattatcataaccaggatgataattagcaagataatagtgttggttgtgcgagaggtcttccaaagatggccccggccttccgaccggggcattatctttaatactgattgaacatcgtctggatctgttttggatctttagtctgggttaacgccagttgcagtaagacacgcgctttttgcgggttcagcgtgccggaagcgacaaagccgtattttgcatcgtcaacttccgcatcctgcgtggttgcgccagtcggcacacgtgaagaacgcaccactaccgtaccgttgtgcgcggcggtcgctagggtatcaaagaccgttttatacaggttgccgttacccacgcctgcgctcacgatcccgtcataacccgcgtctaccagcgcttttgccggcagatcggacgcattcgcatagttataaacgataccgactttcggcaacgcggtcagcttcgacacgtcgaacggggtggaggtggtatgtttacgctctggcgtacgctggtagtcaattttaccgttgtggatataacccagcgggccgtagttaaccgctttaaacgtcgccacgtcagtcgtattggtcttagtgacgtcgcgtccgtccatgacggtatcattcattaccaccagcacgccgcggttggcagactgtttatcagccgctgttactaccgcattatagaggttgaacgggccatctgcgctcattgacgtggaaggacgcatcgcgccgaccagtaccaccggtttattgcatttcacggtcagatcgaggaaataagcggtctcttccatcgtatcagtaccgtgggtgatcacgaaaccgtcggtgctgtcgcactcggtattgatttttttcgccagcgtgagccagacttcatcgttcatatcctgcgagccaatgttaacgacctgctcgcctttcactaccgcaatgtccttcaattgaggaacggcatccaccagattttcgacgccgactttacctgccgtataatttgattttgttgctgaatcaccgccgccagcgatcgttccgccggtcgctaagatggtgatattcggtaaagcgaacgctgcgccgctgaaacccattaccagagcagctaatgccgttttcctgaaaaactccatgttatatctccagttatgtcaactggtcgcattatccctatattgcagacgaataatgtgacgccatacgattaaccagcgatatatatccgacagagagtattttttagagatggataacaaaatgcaggaaaaaacagaataaaaaggcgcagatacgatctgcgccattgttgtctatggaaaacccccagctaggctgggggttccggaaagcttttagctttaagtcagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcggaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaatacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttacaggcgcatcagaaaaacctccggctatgccggaggatatttatttaaaaaggaaagattacttcaggctgccaaccagcgctttgcggctatcttctaaggtcactacgcggctacagacatctttgccaaactgctggaaatctttctcctggtttttccattcgttctggatagcggtttgcaaaccaccgagactacccatcacgccctgtaaaggattgccgccgcctttaagcaccgctttggcgcccatttcgttaatgctgtcctgcaaaataccgcccatcgcctgattcaccaactgctgaccgtcggcacgcacctggtcgatagccttatagtggaacgtcaggccgtccgtacgatgttcgataatgcggttcatttgcgcttttaattgcgcatcaagcttcgtcaggcggctgcgcatgttgctgctttcgcccacctctttagcgatgattttatccagcgccacgcggcctttttcgacgcgcgatcgggcgccctcatcaatccacggcagcgcgcttcgcagttccgcctggtaatctttcgcctgctcgcgctgcgcggcgctaagggtgtactgcttaccgttgtacatcacattgccgtccggcgtgatcaccaggttgccgttttcacctttcacctgcaccgtttgtggactcaggatcacatcgtcacgcggcgtgacgctgcatttgtaatctgcatgagcggccatcgccgtaaacgttagcactgccgccagcagcgttttgcgcatcataactttccctcaagacaaagcgggccggcatttgccgaccctgtacttattagtcccaccaaacgtcgaaaagttcgctggttcggacttcttcaaggttgcgcgcttccagccacttacgcacaatcgcctgatgttcttcggtacatttaccgatttcctgcatacaaatcagcccttcccaggccaggtagccgctgccgtcaaacgccagtttattaggctcaataacgtcattaataaagtcatcgacagtcttatcgatctgctcttcagatgtaccttccggaaaacgccatgccaccgaaaatcctaattcctggaattcgtcaatgtgcatttttttacgcagacgacgactacggttctttgccattatttcaccctctcgaacattaagtcccatacgccatgaccaagacgatggccacgttgttcaaatttcgttaccgggcgcgattccgggcgcggtacataatcattgctctctgacagatttttgtacccgtcgatagaagacatgacttcaagcatgtgttccgcatacgcttcccagtcggtcgccatatggaaaacgccgcccaatttcagcttgctcaataccagttcagcaaacggcacctgaacgatacggcgtttattatgacgcgctttatgccacgggtcagggaaaaagagctgaaccatcgataaagaattgtcaggaatcattttatgcaacacttctaccgcgtcgtggcacatgacgtgcaggttttcaacgccctcttcatgagcggacgccagacacgcgccgacaccgggtgaatgcacttcaatgccgaggaaattctgctccgggcgcgctttcgccatcgccacgagagacgcccccatgccaaaaccaatctccagcgtcaccggcgcttcgcgaccaaacaacgtggcgaaatctaccggcgcttcgctgaactcgacgcccatcaccggccagtagttttccagcgcgtgctcttgcccctttgtcagtcgcccctggcgacgaacaaaactacgaatacggcgcagcgggcgaccgttttcatcaaattccggtgaaatgacgtcgtttttcataaaagtgtagtctgctgtgtttgagttctgaaaacgggcattatccaaagttagttgccggatgcaagcatgaagcgcactgcggaaagttccggtttacaccctgcggcctctgtgctgcaatcttgcccccggcaataatgaatgagtttccatgcaagcgtctcaattttcagcccaggttctggactggtacgacaaatacgggcggaaaacgctgccctggcaaattaacaagacgccttacaaagtatggctctcggaagtcatgttgcaacaaacgcaggtgacgacggtgattccttactttgagcgatttatggcgcgctttccgacggtaacggatttagcgaatgcgccgctggatgaagtgctccatttatggaccgggctcggctattacgcccgcgcgcgtaatttgcataaagcggcgcaacaggtagcaacgcttcacggtggagaattcccgcaaacttttgccgaaatcgccgcgctccccggcgtcgggcgttcaaccgccggcgcgattctctccctcgcgttaggtaaacattatccgattcttgatggaaacgttaaacgtgtgctggctcgctgttatgctgttagcggctggcctggaaaaaaagaggtggagaatacgctgtggacgctgagcgagcaagtgacgcccgcacgcggcgtggagcgttttaatcaggcgatgatggatctgggcgcgatggtttgtacgcgttcaaagccaaagtgcaccctgtgtccgctgcaaaacggttgtatcgccgctgcgcatgaaagctggtcacgctatccgggcaagaaaccgaaacagacgttgccggagcggacgggttactttttattgttacagcataatcaggagattttcctggcgcagcgccctcccagcggtttatggggcggactctactgctttccgcagttcgccagcgaagatgaattacgtgaatggctggcgcaacggcatgttaacgctgataatttgacccagcttaacgcgtttcgccacacatttagccatttccacctggatattgtgcctatgtggcttcccgtgtcgtcactggacgcctgcatggatgaaggcggcgcgctctggtataacttagcgcaaccgccgtcagtcggactggcggcccccgtggagcgcttgttacagcagttacgtaccggagcgccagtttaacgccccggtcgatgaagaggatgacttatgagcagaacgattttttgtacttacctgcaacgcgacgctgaagggcaagattttcagctctaccctggcgaactaggaaaacgtatctataacgagatctctaaggacgcatgggcgcagtggcagcataagcagaccatgttgattaacgagaaaaagctcaacatgatgaacgccgagcaccgtaaactgctggaacaggagatggtgagcttcctgttcgaaggcaaagacgttcatatcgaaggttatacgccggaagataaaaaataggcccgttgctgaatgaggctgcgcttattcggcctgtgagttatgccggataagcccttagcgccgctgcccggcaacatggcataacgacaacacaacatgcactcccggaatgatgaaaaaattactcgcgcttgctgttattgcgccgttgctcatctcctgctccagttcgaccaaaaaaggcgagacgtataatgaagcctgggtcaaggataccaacggctttgatattttgatggggcaatttgccaacaatattgaaaatctgtggggatataaggaagtcctgatcgccgggccgaaagactacgtcaaatataccgatcagttccagacccgtagccacatcaactttgatgatgggaccattaccgttgaaaccatcgccgggacggaacctaccgcacatctgcgccgggccattattaaaacgttgctcatgggtgacgacccaacctccgtcgatctttactccgatgtcgatgacataaaaatttctaaagaacccttcctgtatggtcaggtcctcgacaataccggccagcctattcgctgggaaggccgcgccacgacattcgcggattacttgctgaaaacgcggctcaaaagccgcagtaacggcctgcgtattatttacagcgtcaccattaatctggtgccgaaccaccttgataaacgcgcgcataaatacattggcatggtacgccaggcctcccgtaaatacggcgttgacgagtcgctgattctggcgattatgcaaacggagtcctcgtttaacccgtatgcggtcagccacgcggatgcgctgggcctgatgcaggtagtgcaacacagcgccgggaaagatgttttccgttctcagggtaagtccggcacgccaagccgtaacttcctgttcgaccccgccagcaatatcgataccggcacagcgtatctggcgatgttgaataatgtctatctgagcggtatcgagaatccgacgtcgcggcgctatgcggtcattactgcctataatggcggcgcaggcagcgtattacgcatattctcgaacgataagattcaggccgcgaatatgattaaccgcatgtcgccgggggatgtgtaccagatattaaccacccgacatccatctgcggagtcgcgccgctatctgtataaggtgaattccgcccagcgatcgtatcgccgccgataaaccatcgcatcccgcctctggccagcaaatgacagaggcgggaaaggcaaaagtgttaactccgtcacccttttgctttgcaatcagaaattgtttgcaaatatttgtcacaggtaacaaaaaaagcccgcctctcattgatagaatcacaccaaatcacaacggcaaatgtgccttttaaaacattcatccgctctcaggtgtgaggaaattaacatgaatcttaagctgcagcttaaaatactctcttttctgcagttctgtctgtggggaagctggctcactaccctgggctcgtatatgttcgtcaccttaaaatttgacggcgcatctattggcgcagtttatagttcactggggattgctgccgtctttatgccgaccttgctaggcattgtggctgacaaatggctgagcgcgaaatgggtctatgccctgtgtcatgtcgtcggcgccatcacgctattcatggccgcggaagtcactacgcctggggcgatgttctttgtgatcctgcttaactcgttggcttatatgccgacgttgggcttgatcaatactatatcgtattaccgcctgcagtctgccggcatggatattgtgactgactttccgcctatccgtatctggggcaccatcggctttattctggcgatgtggggcgtgagtttctccggtttcgagctgagccatatgcagctttatatcggcgcgacgctttccgttctgctggtactgtttacctttaccctgccgcacattccggtggcgaaccaacagaaaaaccagagctggacatcaatgctgggccttgacgcttttgcgctgtttaaaaacaagcggatggcgattttcttcatcttctccatgatgctgggcgcggaactgcagatcaccaacatgtttggcaacaccttcctgcatagctttgataaagatccgctattcgccagtagctttatcgtgcagcacgcctcggtgatgatgtcgatttcgcagatttctgaaacgttattcatcctgaccattccgttcttcctgagccgttatggtattaagaacgttatgcttatcagtattgtggcgtggatgctgcgtttcggcctgttcgcttatggcgacccgacgccgttcggtaccgttctgctggtattgccgatgattgtgtacggctgcgccttcgacttcttcaacatttctggctcggtgtttgtcgaaaaagaagtacgcccggaaatccgcgccagcgcgcaggggatgttcctgatgatgaccaatggcttcggctgtatccttggcggcattgtgagcggtaaagtggtggagtattacactcaaaacggcattaccgactggcagaccgtgtggctcatcttcgcaggctactcgctggtgctggcctttgcgttcgtagccttgttcaaatacaaacacgttcgcgttccggcaagttcgcaacccgttgcacattaatccttgccctgtttcgcaggccggataaggcgtaaatgccttatccggcctgcaggcaacgttactttaaaacatatccatacaagcgtttaattccatcggcatcggtctcgctatataccccctgcaattccggcgaaaaaccgagcaacagattgatgccctcttccagcgccaaaaaataacgctgcgccgcgccaccccaaatctcccccggcaccacgcacagtacgcccggcgggtatggcaatgccccctcggcagcaatacgcccgcccgcctcgctgatacgcaccagctctacatcgccgcgaataaaggcgctgttggcatcctgcgggttcatcgccacatgcggcaggctttctttgcgaaacatcgctttttgcagatccttaacgtcaaagctaacgtacaggttgtgcatctcctgacatagctcacgcagggtgtaatcgcggtagcgcaccgggtatttctgaaaaaccgtcggcaatacatccgcaagcggcgtatcgtcttcaatgtgccgttcaaattgcgccagcatcgcgaccagtcgcgccagtttctcttcgctctcggcgggtgtcagcaagaatagaatcgagttgagatcgcacttctcaggcacaataccgttctcacgcagatagtgggcgagaatggtcgccgggatgccgaattcggtgtaccgcccactatcggcatcaatacctggcgtggtcagtaacagtttacaaggatcgacaaaatactggtcatccgcataaccctcaaagccatgccatttcgccccgggctcaaaactgaagaaacgacgattgctggcaatggtctccgtcggatatgcctgccacggcttgccgtcaaccaccagtgggataaagggctgaagcagtttgcaacgggcgagaatggctttacgcgcgtcaatgcccagcgcaacgcactccgcccacaggcggcgaccgctctccccttcgtggattttggcattgacatccagcgccgcaaacagcgggtagaacggactggttgaagcatgcaacatgaaggcgtttgtgcgggcaaaaacgcgcctggccgcgaatatggttatcttttttgtggatctgcgaggtttgtgagaaccccgcctgttgcttatgtaccgattgggtcacaaagatcccagggtcgttttcattaagctccagccgcaacggcgaggtatccgccatcatattgataaactgctcatagcctacccacgcggagtcaaacagaatgtaatcgcagagatgcccgattttatccaccacctgacgggcgttgtaaatagtgccgtcataggtacccagctgaatgatcgccaggcggaacggacgcggcgcatcggcgctttccggcatcacgtcacgaatctggtcgcgcaggtacgtttcatcaaaacagtgcgcatcaataccaccgataaaaccaaacgggttacgcgccgcctcaagatagaccggcgtcgccccggcctgaatcagggcgccgtggtggttggatttgtgattatttcgatcaaacagcaccagatcgccgcgcgtcagcaaggcgttggtgaccactttattcgccgccgaagttccattcagcacaaagtaggttttatccgcattaaacacttttgccgcaaatttctgcgcgtgtttggcagaaccttcatgtattagcagatcgccaagtttcacatcggcgttacacatatccgcacgaaacaggttttcaccaaaaaagtcataaaaatggcggcctgcgggatgttttctaaaaaactcgccatgctggtgccccgggcaagcaaaggtactattccccatgtcgacatactgggtcagggtgccataaaagggcggcagaagttccgcttcgtagcgacaggcagcgttttccagctccagccattcctgcgcgttcccgccgattaccgccgtaacgccgacaggcgcgctgacgggttcatccgcaagcataaataccggcaggtgaaaaccggtgcgtttaagcaacgccagaataccgctacggctgtcggcagtggtaatgacgactgcggccacatcggtaaagtcggtactttccagtgccactacgtttcggtgggtggagagacgggggatgagttcaccgctggcggcaatattcattgatttcataagcgcaaatacccgtttcgggagtagagtaaccccggacaaggccgatgccttgcccaacgagatgccgggtcaaactggataccagctccgaccgccagacatcagtaaaaacagactgtttctgattttactgttgtcctgcagtgagcgtgcgctgccctcaccgcatagcggggatgacaaaaaaaaggaaagaaaggggcaaacctcgcgcagtcaggcgacagtgaagacaatataaaggcgctatgttcatcccggcgagccccatgctggcaggagaaatttcgcgcaatcatggcacctttcaccagacggcgcaaggtaaaatcagcgctctatacgtcacagataatcaagctattaacagcttaatcgcgtgataataaggcaatttgaaagacaaataacaggagtcattgtggtaattggaccttttattaacgctggcgcaattttattcggcggcgttattggcgcgctgttaagtcagcgtctgccagaacggattcgcgtctcaatgacgtctatttttggtctgtgctctctgggtattggcattctgctggtgatgaagtgcgctaatcttccggtgatggtgctggcgacgctggtcggcgcgcttatcggcgagttttgtttgctggaaaaaggcattaatggcgcagtcgcgaaaatccaacaattatttatggcatcgggtaagaagccgacacacgactcttttattcaaagttacgtcgctatcattgtacttttttgcgccagcggcaccggtattttcggcgcgatgcatgaagggatgaccggcgatccaaacattttgatcgctaaatcttttctggatttttttactgccattattttcgcctgttcgcttggcatcgccgtttcggcgatttgcgcaccgatgttgattatccagttaacgcttgccgcctgcgccaccctcattcttccactgactacgccggcaatgatgggcgactttagcgccgtgggcgggctgctgctggtggcaaccggcttgcgtgtatgtggaatcaaaatgtttccggtagtgaatatgctcccggcgctgttgctggcgatgccgatctccgccgcatgggcgatgttttttgcctgactctgcgtgcaataacaacaaagtggtgatagattgtgcagtctacgttgatttgaagaaatttcgttgacgaagcgaggcgattacggtttaatgcgcctcgttgcccggatagctcagtcggtagagcaggggattgaaaatccccgtgtccttggttcgattccgagtccgggcaccacctttccttttttacacttccttataaatccccatgtgtttttaattcaatgagttagtggaaaaactcttcccagcgaatttctatttatccgcccaaatcaggggcttttggtggtcaactcggtgctcagttcggttagataaaggagtgccctcaaatggcattaaccgacaaacaagcacgtagtgcaaagccttctgataaaccctataaactcgttgatacactcggcctgtatcttctggtaaaacccaacgattttcgtatctggtatttcaaatatcgttttgagggaaaagagtccggggtatcattcggtccttatcccgaaacctcattcgcccttgtccgcgaaaaacgcgatgccacccggcgcgtactaaaatccggctttaccccttctcagcagcgccgggacgaaaaaaggttgtcaatgaattagaacgttccagtacatcgctagattgtggcataccggctgcctgaaactctggtcagaaagtcactccaataaaattcctgtctgcctccaacactacgttttccctgatatcggcgcaatgggtatttcggcgacttaaaccctacatctcgcacgactggtcagagacattgatgataaaggtgtgcatgttgttgccggacgtatacgccagcatctgaccaaaattatgcgccacgccgtacagcagggaacgattaaatataatccggcattcgatctggatggcgttgtaactcctgttataacccagcatcaccccgcccttcccctgaaacgcctgcctgaattgctgggctatatcgacacctacaacaaggccggataccggctatcaacactttccggtatgccgcactgccaggacaacaccaaacgtgagttcacacatctggttagagtttctctggcttaccgcaaaattgagtgggaacacgtttcaacaggcacttcaggtgctgatgactgacgtgcgccgctggaagcataagagtaaatccacagcattccgccttaatggtgggatgctgtttttgtccgggaacggagacaaaaagcccgtgccagcaatgagttacgtctgttacgtttcatatatgggagatggtggatgccggaaactttggcggtagcgtgcctgaagcggctgtcctccccattgccactgccacgagcgtaccgtggttcctttttcgccaataaatccagaataaggttatgtcacaaaatggcctgcgttttacgctggatgtggacggattaacgccggcggcaaccactgtcgtcagcttcaccctccagaggtatcaacagttcaacaggtgcaagctggaataagaatgaaagactaaaaacaccagatgatgcatccaatgatagcattaaatcaggccatggttcacaggaggaaatattaccatcttacctttacttaataagatcatttttaatgaaaataggtttatcaataaaacaaaaaatattcttgacagcgaaattgcatcttttcttgcatcttcaagtcaggaaggatttgatttagtggatgataacaataattatctttttgatcgcacagttaaaaaaattaggcgcattagctgataatgaaatgtttggtttggaacctgcatacatttttggcggggaaataaaaaagttttctttattcaaaaaattgaattttctgatggtaagattatcattgataatgaatctgtgtcatggtcactaaaaaatttagtacacaaacagaatactcatgctatatccaaattcatagaaaaaagaaagagaaactttatctaataacaaattttaaaaaaatcagcagtgcgttgagaaaaccaatacatacattcccagatggaattatgccatcaaatagaagagaaaataaattaattaatatcctgaattcgcataaaaaagattcagagtttagatttttattaaaagaattaattagttatattggagttacagtaagtacaatgttcctatcacttattaactcctaataaataattattcttattttccaggataatctcacaacttattatttagtaatgaagctatggagaaaaatgcccacagccgcccgactcaacgataaaggcacccagtacgacgattattacgagaccgtgagtatagcggattcccccacggtatttattgacggcctgtccgttgccagaatgggtgatgcggtggactgtggcgggatggttaatatgactcgaatgaaatcaggtaaggcatcaaaggttagaaaagttgacagagtcggaaaacaggggttcgagcttcatcatatagatgaagttgcaaatagaggcgatgtttacaatgtagacaatccccgtgtgaacaccatattgacatacacaggcgatttatgaaattaaaagaaaatattagtgattatacggaaagtgagttcattgatttcttgagagtgatattttctgaaaacgagtcggatacagatgaaacattagatccattacttgagtattttgagaagatcactgaatacccaggtggaacagatcttatctattatcctgaaacggaaagtgatggaacacctgagggtattctgaacataattaaagaatggagagaatctcaaggattgccttgttttaagaaaagtaaatgaaaatcaggtgtaggggaatgcccagagttactggcgcagtttagtaaatcgaatcaaactttgataaaaagaggtcgagcgccttactccttgataaggcaacaagtcggaggtaggtggacttatgaaattccccacgttggaaagatccagtatggaggaatggtgtttgatgttgataaccttatgataaacactcctaaaaatcatatacgattgcataagtaaggtttgaggtgaaaatggaactaaaaaataaccttgaagattatacagaagatgagtttatcgagtttttaaataatttttttgagcctcctgaagagttgactggagatgaattatcgaagtttattgataatcttctacgccattttaataaaattactcaacaccctgatggcggggatttgatattttatccatcagaggaacgagaagatagtcctgaaggagttattgaagagctaaaacgctggcggaagtctcagagactcccctgttttaaggaaaataagtagcgatcagtggtgaggagtttgtcaaccggaaccgggatgataatgcagtgaccgttaaaaggcaaaaatatgtcagttaagggagtaactatcaaaggcataattctgagtgtttttacactgaaccgtagtgccagaggatatatttatctgacgcgaatcgtatgaagtgatagctttacgtacggtttgtgagaggctgtagggaaagatcctacggcctactcactaagagtctatttttgtacattgtttcatgttctggaaacacgataaagtatgagcctgacgaactctcgcccgctaaagttccacgctggaacctgacggccaggagtcggacatctttgcggtggcgaatttacatccgttcaaaaaaatctaatgtaagagatagatgatatggctaaatatatattcctctttatctggattgtgacattttctgtcagcgctggtgagcgaggatattatttattcgtatggggtaaccctgaagggaaggaatattttaaagaatatagagctgatgaaaggatatatgcggtcaataaatcctgttggaatgaaagagcggggaactctatacgaatagtatatgttgatacttatcctcatggaataaccgattctttaattaattcctttttggctgggaataataaatccataataaatattagagtatcattgagtaattttagtgacgatcaaatacttcatggttttgatggcatgttaataataaataaaaaaaatgaagagatcgagatttttactattccagtagttggtgctaattactcatataaagataaatttttagtaaacgtccatgattttgaattatttgatggaaagatctgtaacgctttgatgcctatagatagttatttttcaccataagaagggttgttgaataaatcaaattaccctgtaccgtcaaatgtacctaccgtcgacacgggtaacggatctacatcttctgggaagcaaaaggcaacaacaaaagatgcggaacaattgccgacagagggaaataaaatcgtggagggcctatagctacgggctgagattatctgttcatgatatgtatggcacacacgttaccataacatcattgaatgtatcaaaaatgcctacgcagcaaacgggcattacaggatgcaggatcattttagtcttgacagtaatgatataacacattggctttatagccattgggatgtctttaaaatttggtttgtacttcaacattatgagaaagaggggtatgagtttaagccatttatacacaaaatcattctagatgcattgcggcggcaagggaagaaatccccgggagcatagataactctgtgaccggggtttctgagcgcagccaacaaagaggcagcttaaaggatgaagtgtatattacagaaataaataccaccgtaaaaatctcaggtgtcagaggatattactcctgatttggtatgtattgtcggcaaggtatttgtttgtattgttaacatagcatagtccgatattttgcataaggaatgtgattgtgtcatgggtaataacgaaaaaattcatttatattgtgacaatcgccatattattttgttctgttgttatatacttatggtcaggcagaccagtagaaatcgtggatgtccattattattcaggtaaagacattaacattcttgccaggcatttccccattacggacaggggaaagctgaattggtggagagaaaatgaaagaaaaattctggaaaaatataatctccctaaaaataatttttcggtatatatatgggattttggtgacggttatcaaaaattatcgccctatgatgccgaggatgaattttattgttttcctgatataaaatcagaatcaaaatgtatcaaaaaagatatatatatgcctgctgaatctggtggtaattattatcggatgtttttattttctggttctggttatttttatcaaccgaaaaaagatgatgataagcttatcgaatcaaataactccaccaagctcaaccaggataaaagccatgaaaaaaatcactatcattagtttgtttcttatcttacctttgaaagcaaatattattccatctatatcattaccagataaattaagtgagtcgaaatattctgtaagaatgcttcgcattgatgcaaggattgactatcgcgtggaaacccctgagtgtaagaacgtaaaatttaatgattactttttcttaaatgaaaatattaaagatctcaatgataaaaaccatgtttatgatcctgagttttatccaattacattatggagttgttcatatagcagagaggtgtatgatgttggtgagtatggctcacatatacagcacatcgtttttgataaaaataaaaacatatgggtgatagatgatgatgcaacaaaaacaaataatgaatttaaaccatcatttttatataatataagttcagtgaatgcacagggtttcttaatcattgatgagaatatttcggagatggataaaacaatatacgaagatgataacataaaaaagaaattttatttttgtatgattgatggctcacatgctttatgcggcgcaggcagtttaatcagaaaaatagataatcagttgattgattttacgccatacatattaaagtcactggaaagtatggagattggcgttaattaaaaaagaatatccgatattaatatactctaaataatttgagttacaggaatgcagtaaatttccaggagtctggatgttggatactgagatgagcgtatcattaatgacgaggttactctgcgttatttaagtggttcatgccgctttagttctgtctttgacacagacgagtggcttaaaactccaggtgagagcaattatcatttttctgttccacttgataatatgtatcatttttatcaggtcagcatcgttatagtatacgtatagtggattatttaatcgttgatagaaattagctttcaaaacaagaaatttactatcatgcgctacgcctgttgacgtttacgcctaataagatatgccagaaaacagataatggcagggttattcttcagcataaaattaactgtcataataatggtgatggcgacacataaagaaaaaccatgaaatataatgaaggcacgtttaaatatatgctcaaaaaaatcattggcgctctcgcgtcaattattggcgggctacttgcttttttatgtgtctattggttatttcgtctggatacctggacagaacgaggggtttatataggcatctctatatttttggctcttattctcataaaaatactatcatttttcaatgatgaatagacggcaggaaaaaccgtgagtgtctcacaccgattcttgctggatgtcaaatttcgaaagcctgccctgctgataccctatcaagaagaaactaacccaacaattatcagacagtagcaggaatcgaacccacaccaggcaaatcacgtagataattctgtaagggttagttttgtggtggtcttgataaacggtaaaaaatagctttaacagtccattagcccaaaggacttctccgagtccgggctccaaccattcagatgcggacgccctatggcgtccgtttttatttataaaatcaacaggttaccccgcccttcatgttcactactgttcattaaaatatactggcagccaccgctttttgtgggtaaaaacgccggttttctgcatagcgcatgacgctattgaaacgttatttagcaaatcctgtctgagccagaaattaagtctctgttaacctgcgctattacagaaaatcatagaacagtcgtctcaaaagaatatcgtcctgaaggacgagaactcacggcattttcaggagatgagtcaaccgcgacagaaaaaaatcatattaataattttaaattattttttataaaaccagacaggatttaaattaaaatcatttattttcaagatgttataaaaaataccgcaacatacgtcacattattaacatgtgaatgattgtgttaaccgaatgtaaattgtatgtttcaacataccactattttactgcgccccgacgcgctcatccggatggaaggagataacatgtcagccttatcaactactggccataatgacgggatcactctccattgcttacagagcattgcgcaactcattcctctgtcgtcggcggttttttatcgtgttaatgcttatttaaagccggaagcctatgttttacataatatttctaatagcacacaccaacaatatctggagcattttcaaccattagacccgctattgccttcccgattcggccaacaggttattacagtagcgacgatgacgcccggcatctgtgctcgtcatcgccattattatcatgaatttatgctacctaatcatgtgtgcgacatgattgagatctttattcgtcggggccatcgtattatcgcgggcatttcattaatgcgcgatatacctttttccagcgaagagcgtttgcgagcccaggcagtacaaccattattgggactggcaattcatgattctcttcaggaagacaacgatctggcgtcaatattgaccgccaaagagcgtgaaattgtgggaatggtctgcgaaggggccagcaacaaattgattgcccgtcagttgaatatttctctctcaacagtgaaaacgcatttacgtaatatttttgctaaaacagaagtgataaatcgcacggaactggtttcccgaaccagaatgtcctcggtacaacattcactgaatatgtgaaagcgttctttttaacccgcgtcaattgcgggtcttttccccatatgtcatatatgcctgaattaataccaccctctgagctgatgccgcaataaaatgtcatattatctggcgtcggcatcctgttgcagccattgattcatggcctgattgatcatatttatcacactaagcagaagaacacgctggtgccgctcaagccgcagataacggcgcagcggcggcattttacaaaccacttcgctagcagcccatagctcaatgctgcaataccattccttatgatgtaaaaccagagtaaaccgacgataatccagttcactcagagcctgttgtaaattggggaaacgattaagatagctaatcagcccggcggtacttttactgccagtaaaaatgacgggataacgtttcagccatccgggctgatgagcgcgaattttgccctgcaaaggataattgattgtgcctttcaccctgaattcacaactgtgaatactggccatgaataaccgtttttgctgaacatggcagataacctgggtaaatgcattcagatgcagcacggcgctatgttcggtcaatttttcacaacgccagccgctcaaatcacgtaacaccatattcattaatgcgttcttaaaccaggggacggaggacatctggcgtcatctcttcattgtttcgcttttcataattgcccatcgcccgttccacgacctcttctaccggaagcgggaggaaaggattaacccgttgcacacataatgtccagaataaggcataggcggcagtcaatccaagcataataccgaatggtataagtacatcccgactgttcattcctggaggcgcgatattaataatggcgataataatacccacgctcgaaataatctgaggtaagggaaaccagggggcccggtaagcgcgtggtaaatcggggcgccgaatacgtaagataacgaccgataacgttaccagcagataagctactccccaggcgcagaccgcagcgaggatcagcggaacaatgtggtcgatatcaccgttcagataccaggcatgtaaacagggaatcgcaacaccgaatgcgatggcgatgaccggtgttttaaagcgggggtgcaaccaggtcagaaaccgcggcaaagcgccgtccagcgccatgccgtatataatacgcggtactgccgccattagcgtattaatcgtcgcacatcccgctaacaacaaccccacgcccagccagtattgcccgacatgtcccatgacacgattggcaaaggcgggaatagccatcggcgtatccagtaaaaagatatggtttgccgcatcgaccaccacattatttacctgccggttaatcgcagcgccatagaggaacatacaacctgccaccgctaaaaggccaagcgccatcgctctgggaatcgtacgatgcgcttttttaatttccggcgccattggcgtgaccagttcacaaccgacgaacataaacatcgccatgcctatataaccaaacagaccagaaagattactgacatcaagcggtgcgccaaaccacccggaatgatgagtgaccggggataacaggatcccgcataaaccgaagatggtcagggtagtccacataccgaatgtaagaaacacttccaccttgccaaatacttcaacaccaatggcattcagtatcccgaaaaccactaccatgccgacgccaaccatccaggtattgtgctgcatggccacgtgttcgctaacggactcaaagttcaccagcgccatgacgccagcgagaatcgtttctgccgtgccggcaaaaatgtgtacgatcaggtaagcgcaaagcgcaccggtgatagcgaaaaaacgccccatcccgcaggagatatagtcgtagacggagccagtcgtgggaatgagcgttgccgcttcggcaaaggtggtaatctgcgcttgcatcataataaatgccagtaataccgcaagggcaaaggtatctccccctgagccaaaaccactggtcacggtcaggatcaccgggcttgccataatcagcccgacggagctggcaagcgtcgtggggaaaccaataacgccacgttcaagatggctggcaagtctgtttttaaacatggtcaacctcttcactattattacaacaataaattaccgctccggaataacgcttatttatggcaggcagcgcatctaacaggtatcgtcctgaagagggataacggtaaataacgttgtgacgccgtccccgcatgcgctaatagcaagtggggagcgcgttattctccccagtgatgccaacgctactgacgaacaattaaagggttcaaccctgtttatggctttcaacgtttgccagataatgttttacaaaacggggcgttaaaactttccatgccacttcggttccctgttcaacaaaccaactatcgcccggtgaaaaacgtatcggttcctgacccacaacagtgagttccacttccccttccagcacggttgcgtgctcggtaaagggataaatcatagtgaaaccgccgcgggtcgatgaaaacagtccacaggtaaatacgtcctcaggtttaccgtaaatcatcgcaacggcgacctggggacgccttctgttggcaacgcccctaacaggctgacactcccgactggctgtaattcaggaacaggttgattgagtttaaaagcgtgcattaatgttctcctggttaattccggcctttccagaaaccggctgtttgatgtatcagttttcccgcactgaccagcaatagacgtagactgtcgcgaccataaattgtcgcgtggggaatgctactcatcagacgataccgctcggaaccgccatttattccttcggccaggattttgcatacaatatgggaaggcgtgacgccaaatccggaataaccctgaacataaaaaacattattgtgctcacgaagcgtgccaatctgcggaaacagattcgcgctacaggccatcggtccgccccaggcaaaatcgattttaacgtctttcaaataaggaaagacctccgtcaacagagtgcggttccaggcagcaaaatcgtgcggggtatattcaagaaaccttgtggcgctgccaaacagcagacggttttcttttgtgagacggtagtaatttatcaccgggcggatatcgctaaaagccccgcgcaagggactgatccgctcaacaagctcgctggagagaggttctgtagagacctgataagaataagtaaccagcgttttcttataaatttctggttccagattattgagaaaactatcacaggcccacagcaatttggctgcttttacgctgcccatcgcagtacgtacccgcacagttttaccgtaactgacctcaaccacaggtgaatattcgaatatcttcacccccagcgaattcgcagcctgagcggagcccagcaataaattcagcgagtggacatgccctccccccatatgcttgagaacaccgcagtagacgtcggaaccgataacctgctgcacgtctttaccggtatagagttcaatatcgtcttccggcgtagcggctttgaattctttttcccattgttgcagcgtttttaactgccgctggttgtaggccagataaccatatccggggacaaaatcagcatcaatatggtatttacgaattcgctcccgaataatacccgcgccgaggttcgagattttaaacagcgtctccattcccgctgcgcctacatattttttaacggcttcgatgtcgtgacctataccggccatcacctgaccgccgtttcgcccggtgccgccatacccaagatggcgggcttccagaacgacaacattagtgatcccctgctccgccagttccagcgcggtattgatgcctgaaaagccaccgccaatgatcaccacatcggcatcaatatcgtcttgcagagcaggaaaatgcaacgggtattttttcgtcgcgccgtagtaattcaacgcatcgatttttgtattcatcgcgttaccttgtcatcacgcttgaccaagaccgctatcacagcacggtaacgttttacaaaatatcgtccggaagaatgacgttctttggaacgatattcagttccaggcaagtatgttgagatggaaaaacgtacattcctgacctacaggcacttctgatgagcgacgtgacattacttgccgaagtaacgacttttttacgccaacgacacggacaatttattgcaggtgaacgtcaggccggaaacggcacgaacttctcggtcactaacccagccaccggcaaaatcatcgccgacgttgtgtcgacaacccctgcgcaggcaaaagaggccatgcagagcgccagacgggcgtttgatgtctggcgtaaaatgccaacgttacaacgcggcgcattactgctgaaactggctgatactcttgccgctcatcgtgaagagttagctcaactggaaagcgtctgttcaggtaaaacgattatgctgtcgcgcggtcttgaactcgatcagtcagtggccttcctgcgttactttgccggttgggcaggaaaaataaccggtgaaacgctgaatgtctccctgccatcaatgggagaagagagatacacagcgtttacccaacgccaacccattggcgtggtcgtcggtattgtgccgtggaatttctcaattatgattgctatctggaagctggccgcagcgctggtatgtggctgcaccatcgtcattaaaccaagtgaatataccccgctgacactgctgcgagtcgctgaactggctaaagaggctggtttccctgatggcgtaattaacgtggtaaacggtgctggcggtgagatagcgcaacagctgatcgcgcatccagattgcgccaaagtgagtttcaccgggtcagtcgcgacaggtgagaaagtccggcgttcggcaacgtcgtcaggaaaacgcgttaccctcgaactgggagggaaaaatgcggcgctgtttctcaatgatctcacggcacaagccatggtcaacggtattcttgaagccggttatctgaatcaaggacagatttgtgctgccgcagagcgtttttatctgccccaggaaaaactggatacggtcatgacgctcctcagacaacggttatcggagatcgtgcccggctcgcctttagatgaaaaaacggtgatgggcccgctggcgaatcaggttcagcttgaaaaagtgctgcgtctgattcaacgtgcacgggaagaaggggataccattgtttacggcggtgaaactttacccggcgaagggtactttttacagccgacagcggtaaaagtgcgtagtaaaaacagtacgctgatgcacgaggagacctttggccctgtctgtagctttatcggttatcagaatgaaaaagaggcgctttcgcatatcaacgattcgccattcggccttgctgcaagtgtgtggtcggaaaatatatctaaggcattacgctacgctgaagatattgatgctggcatggtgtgggtcaatatgcataccttcctcgatcccgcggtaccctttggagggatgaaaggatcgggcattggtcgtgaatttggcagcgcgtttattgatgactataccgaacttaaatcggtcatggtccgttattaaccatcctgaaaatgatgcaggcagatcaaccataccgaaaggaggactgtctgcctgattatcaggttcgctcgctgcgtttttttgcttttgggataatgttaaacgcccggcccggcgttccttcctgcattactagcgccatctaccgttagagtaggctatctccagtcttaacggttcagactcatcctgtaacatcgcttccaaagacaacgccagcgtctgatgataggcatcttttacactgactttcagcatgttgatgctcggttcataacgtaaaatagcagcgcgaagctcacggcaaaaccagttgagaacccgtttgtcacccacattcacctcgtgccattccggcataccccgagtgagcagcggcggtaatgtctcgccacctggcacggcgcaagagttgaataaacatattaatttgcggcgtaccaattcatgtgggcttatcccctcaaccaagagcctgtcgaatagcgcgaccggaatggttggcgtcatcatcatttccctatctggtccatcgccagatcccatactgacgctctggactcctgttgagcgccgtctgatttctcggcagtgatttgccatttgattttcgtgaagttcagcgacatcgtttccaccggcttaccgccggcgccgccgctaacactgagttgtgatatcagcacgtttgtcagggtataaacgataagcgaccgcattttgccgtcgtcattgcggcacaacgtcagcaccgcggttctaattagcctcccgctacagcagtactcattgagcacaggcgtggcgaggtcgacaaatttggtgagcgacatttcaccaacatgcgcacgcccggaagtccgctcagtgaggctaacatcgttatttacctgcattgccacattgtggctataagacatgatctctatctgatcttcaaagccttcaacctggctttcgcctttgatattgtcgagctttaaaaaaatcgcatccatgatttatctccttgttgatcaggtggcagttcagcagccagacgaataccggcggccaacgcttgtgactcttattaaaagcgcaacgaccaaaaaacacagcgtgaaaagcgccaggtttgcagggattttgccaacgtttacccacgtctgatgaacgttattccgctggttgcaatgcaatagagggttttggcccgctgtggccaaatacaattgaggttatactgaacgctctctgccatattcaatcccttttatcgcaaagtatccctggtgccggtatcacagcgtcgttattcaaaaattgacatttcagaataataatcagctatatataaaaaacacatcaagaagcaaatatcaacttaatttttacttatttaataaaaaaaatccaaattgatttacatcaattaacacatacaaaagcattaaaaatcaaagcattaaataaaaataatcactatggaaaattttatttttcttaatactcacattataaattttatttgcttattttcctgtgaacacaaaaaatgatttaaatcaaaaaacaaactattctcgttgattaacgttttgaccgaaataaaaaagattttatacgtcccgggatagtctccctttctgatggacaatatgcattaacaagcgggcaaacaggtaacttctgcccgggtaatccgttacccgactgatattaacattgtcatgaggtgatatcatttgcctggccagccataatcatccggaaccggcgctacgccacgaacatcaggacggagcattttttgtcgatcctcttcgtcatccacccagacactggctatctcttcacaggttgcaaaccatacgccatcatgccctttaatatgttcaatcaaacgtgacaacatcatcatatgatgcccatgaccgattatctgcggatgaagagccatcgcatataaaccgttttcctgatggttataagcataggtaaaaatatccttccagcgtcgcagaacaccgtcagtatcgctcatcccctcctggttaccggtatacgccagtgcgggaaaatcatccagataccagctaacaggaatttccagaatcgcgctggccgggcctgcgatatttcccgtttcccaattcacctgccaacgttgaggatggtaaggcacaagatctctcgccatcaggctactgtcatagagaaaaccggcttcctccagaagatccagcgtattctcgctataatcccaatagggagaacggtatcccacagggcgtatgccaaaatgtcttttataacaggcgaacgccagatccataagtcggcgttctgtatcacgattcaccagcgtcgggttttcatgatagtagccatggtgagcgatttcatgcccggcatcaaaaatcgctttactgatttccgggaaggtgtctacagtgtgtccgggaataaaaaaggtggttttgatattattttctttgaacaatttcagaagccttggaacgccaacttgtgcgccaaactctcctcgtgacataaaggatggcgacggtcgattaaatccgcccagccataaagactgagcatctacatcgacaccaagattgaccgcaatccttttaccctcaggtaattttaaatatcccataacgacctccagctaatacatagaagggacacattctgttatttaatgtgtgatggccagatattatatatgcctgcttttctgcgtctgtccttgaacgttgttgctgcccccccaagtctattttcatatagaacatcgaggttaatttctcctgaaatgacatcctcttgattgacgtgcgcctctgcgataataccttgtggatttttccacacgacatcacaggggcttaaaattgaacttcgggcccagcagcctggcagtggcccgcccgggtttcctcccaggcaacagtgaacaagataaatttgattttcaatacaacgtgcgtggcaacaatgcctgactcgccaaaatccctgttcagtaaacgtagcggaaggcgttaaaattaactcagcaccctgttccgccagcgtcgcagcacactccggtatttctgcttcataacaaatattaaaacccacctttgcaaatggcagttgaaaaacagccattttatcgccttcctgagtataccaaccccgttcagccgggaagatatgcgtcttactgtgagcataatgttcgccatcgggtccccatatatgcgcaacattctcatagcgatctgctccagtctgctccagatgagagccagcaataatgaactgtcctctttctttcgcttcctgttgaaaaagctgcttataggcatccgtaaactgatcaattaaagttaggtgtgaaatgggtctttcttgccattttttcaatagtgtaaatagctcaatggtaaatagctccgggaagataacggcatcagccccctgacttttattaagaagtatccttacctttgttatgaaatcttcaaaagtgtttatttcagtaacaatacctttgttatgaaatcttcaaaagtgtttatttcagtaacaatatactgacaggctgaaacagtaaaattacgtgacatcgtgatatccccagcatgaaatttaaacttaaattaacgtatagcgcatggagaatattagggagtggacattacgacatcaggttattttttgtgaagctgcgcaaaatatatggagaaaagagtagaagcattgaacctttatttacataaaggggactttatcgatgatcgcagcgagacagagagtcgataaaaatccaggcgaaaaacaataacccttaccacaatattattttcagcatctgaaaataatcaggcaaactaaatgataacgcgctggtataaaaccaacgcgtatttttaccgataagggtaatgaagacggccacccgaaggtggccgttagaacccggtagcgcttcgcttatcaggcctgtgaaaccgagacagctttagcggtgagacgccagcggctgttccgtcattggcgggtggtgcttttccggatctttaatcagtacccacaggatgatggcgccgataatatcgaacagactgagtgcaatgaagaacgggccgtaaccgataatagcgaccaatgcccccataaacaggttgaagcttaactgtcccatccatgccgcagatcctgccagaccggcaaccgtcgcgacctcatttttcttgaacaggtcagcgctcatggtaatcacaacggtagacagcgtctggtgcgcaaaaccgccaatactcatcaatgcaatggcgacatacgggttagtcgtaatgctgacaaaaccgatcgaaatcatcaaaacagcgccgatggtaaagctacaacgacgcgcattgatcgtggtcatgtgcatcttttccatgaagaacttcgccaggaaaccgcctgcaacgcagccgaagtccgccgccaggaacggcagccaggcaaacatggcgatctcttttaacggcagatgcatcacgttaatcagatacagcggcatccagaaactcagcgttccccatgccgggtcagcaagaaaacgggtaatcgccaacgcccagaagttacgctttttaacgatctctttaacggccggttttttattatcgtcctggagatagctttcctggccgtcttcgatataacgcagctctttgtgggtgatccacgggtgtttatttggcgagttataaatcaggaaccaggtgatggcgaacagcacgccgatcccaccggtaatcacaaacgccatttcagtaccgatgccgctatcagcaaaggtcagcatcgcccagaccaccagcggcggcgccagcatcgcgccaattgaagtaccgatattaaacaggccccccgcaataccacgttctttcgtcgggaaccattcggcgctggctttaatcccggccggaatcgctgacgcttcggttagccccatcagaccacgcagaaatgccaggcttatccagccgccggccagcgcgtgcgccatgttgatcagcgaccacaacaaggcaaagataaagaagccgattttcagtccgatgacatccatcaaatagccggtgatcggctgcgcaatggtgtaacaaagctggaaggcgctcaccacccaggaatattgttgctcatcaaaatggagttctttcatcatcgctggcgccgcaacgctaagcgagctacgggacaggtagtttacgatggtccccacgcagaccaggccgataatccaccatcttaattttgtcatcttcatgataaagcctcgttaaaaaacattagctccgcgccgtctgacctgtagcgggaaaactgaaattacaaaaattggttgaccaatcaatattttctcatccggaccggtcaaaatctggcggcaactcccgcccttaatattcttgaaataaatacatcaactcatttcaagttgaatggtgaatgcttttcacccagcaaaaattgacgcagatcaaataaataaaattggcagaccgtgaatgatgatatttgtgatttggctagccaatttagataataaggttgacatgagaaaaattttggttgaatttagggggcagaacgggtttacaaagcacgtttcgatgttggctggcaatgggtcaaccacgaagacgttatcgcaagaagaggaaacgagatatgaaacaaacctggcgctggtacggacctaacgacccggtaacgctgtcagatgtacgccaggctggcgcaaccggcgtggtaacggcgttacaccatattccgaatggagaaatttggtcggtagacgagatccagaaacgtaaagcaatcgttgaagaggcgggtctggagtggtctgtggtagagagcgtacctatccacgaagacatcaaaacccacaccggtcagtacgatttatggatcaaaaactaccagcaaacgctgcgtaacctggcgcaatgcggtatctatacggtttgctataactttatgccggtgctggactggacacgtacggatctggaatacgtattgccggatggttcaaaagcgctgcgttttgaccagattgaattcgccgcgttcgaactgcacatcctgaagcgtccgggagcagaagccgactatacggcagaagagattgctcaggcagagcggcgtttcgccaccatgagcgaggaagacaaagcacgtctgacccgcaacattattgccggtttacctggcgcggaagaaggctatacgctggatcagttccgtcaacacctggcgacgtataaagatatcgataaagcaaaactgcgtgaacattttgcctatttcctgaaagccattattccggttgccgacgaggttggcgtgcgtatggccgttcaccctgacgatccgccgcgccctattctcggcctgccgcgcattgtctctaccattgaagacatgcaatggatggttgaaaccgttaatagcatggcgaacggcttcaccatgtgtaccggatcttacggcgtgcgcgccgacaacgatctggttgatatgatcaagcaatttggtccgcgcatctactttacgcatctgcgctctacgctgcgcgaagagaatccaaagaccttccacgaggccgcccatttgcacggcgatgtggatatgtatgaagtcgttaaagcgattgtggaagaagagcaccgtcgtaaagccgaaggtagcgacgatctgatcccaatgcgcccggaccacggtcatcagatgctggacgatctgaagaagaaaacgaatccgggttattccgccattggccgtctgaaagggcttgcggaagtccgcggcgtcgaactggctatccagcgcgctttctttagcaaataaccttctttcgcatggcgcgacgcgtcatgcgatttcccctactcaatgcaatagcaacatgcctcgccccggagatcgcgggcgaagacgtcgaatgacaggagtttgcaatggaacagaatatcgccaccgcccaggtttccgtcgcccgcccaaactgggacaaatcacgtctggtatcccgtattgtgcatctgggctgcggggcgtttcaccgcgcgcaccaggcgctctttacccatcatctactggaaaagagcgacagcgactggggcatttgtgaagtgaacctgatgccgggtaacgacgcgcggctgatcgcgaacctgaaagcgcaaaatctgctgtacaccgttgcagaacgcggcgcagaaagcaccgaactgaaaattatcggttcaatgaaagaagcgctacaccctgaattcgacggtcatgcagggattctggcggcaatggcgcgcccggaaaccgccatcgtctccttaaccgtaaccgaaaaaggctactgcaccgaccccgccagcggcgagcttgatgtcaataacccgctgatccaaaacgatcttgcccatccacagcagcctaaatccgccattggctatattgtcgaagcgctaaacatgcgccgggagcaaggactgaaagcttttaccgtgctgtcgtgcgataacgtgcgcgagaatggtcacgtcgcgaaggctgccgtcctcggcctggcaaaagctcgcgatgccgccctcgccgcatggattgccgacaatgtgaccttcccctgcaccatggttgaccgcattgttccggcagcgaccgaagagacgctacaactggttgccgaccagttgggcgtttatgatccttgcgctatcgcctgcgaacccttccgccagtgggtcatcgaagataactttgtgaatggtcgcccggactgggataccgtcggcgcgcaattcgttgcagatgtcgtaccgtttgagatgatgaagctgcgtatgcttaacggcagtcactctttcctcgcctatctgggttatctcggcgggtatgacactatcgccgatactatgactaacccggcttaccgtcgcgcggcgctggcgctgatgcttgatgaacaagcgccgacgttgtcaatgccggaaggcaccgatctggaagggtatgcgaatttgttgattgcgcgtttcactaacccctcgttgaaacaccgcacctggcagatcgcgatggatggcagtcagaaactgccgcagcgtctgttggacccggtacgtctgcacttgcaacagggcgatgactatcgccgcctgacgctgggcgtcgccggatggatgcgttatgtcggcggtgtcgatgagcaaggtaaaaccattgatgtcgtcgatccgctgcttgcacagtatcaggcgattcatcagcaatatcagacgccggaagaacgcgttcgcgggctactggccatcgagtctatctttggcaacgacctgccgaagaaccacgaatttgtgcaagccgttaccgacgcttaccaacagctattgcagaatggcgcgaaagccacggtagaagcgctggctaagtaaggagataaatcatggctacgtttatgactgaagattttctacttaaaaacgacattgcccgcacgctgtaccataaatacgccgcgcccatgccgatttatgacttccactgccatttaagtccgcaggaaatcgccgacgatcgccgtttcgataacctcggtcagatctggctggaaggcgaccactataaatggcgagcgctacgaagcgcaggcgtggatgagtcgctgatcaccggcaaagagaccagcgattatgaaaaatatatggcctgggccaataccgttccaaaaacgctgggcaatccgctgtatcactggacgcaccttgaactacgccgtccatttggcattacaggtacgctgttcggaccggataccgcggaaagtatctggacgcagtgtaatgagaaactggcgacgccggccttttccgcgcgcggtattatgcagcagatgaatgtgcggatggtcggaaccaccgacgaccctatagattctctggaatatcaccaccagatagccgccgacgacagcattgatattgaagtcgcgccaagctggcgccccgacaaagttttcaaaatcgaactggacggctttgtcgattacctggggaaactggaagcggcggcagatgtcagcattacccgtttcgacgatttacgtcaggcgctcactcgccgcctcgaccatttcgccgcctgcggctgccgcgcgtccgatcatggcattgaaacgctgcgatttgcgccggtgcccgacgacgcgcagcttgacgccattctgggcaaacgtctggcaggcgaaacgttgagcgaacttgagatcgcccagtttaccacggcggtgctggtctggctgggccgtcagtacgccgcgcgcggctgggtgatgcagctacatattggcgcgatccgtaacaataatacccgtatgttccgcctgctcgggccggataccggctttgactctattggcgataataacattagctgggcgctctcccgtttgctcgacagtatggatgtgaccaatgaactgcccaagactatcctctattgcctgaacccacgtgataacgaagtcctggcgaccatgatcggtaacttccaggggccgggaattgccggaaaagtgcagtttggttccggctggtggtttaacgatcagaaagacgggatgctgcgccaactggagcaactgtcgcaaatgggactgttaagtcagtttgtcgggatgctgaccgactcccgcagtttcctttcttatacgcgacatgaatatttccggcgtattctctgtaacctgctgggacagtgggcgcaggacggagagattcctgatgatgaagcgatgttaagccgtatggttcaggatatctgcttcaataatgcccagcgttatttcacgattaaataatcgctattaatctgtgagcacaggtttcaggtatttcgaggggcaggaaggcggtaagagagtgagaaatttagcagtaacgcacttttccagccaaagtctggccaccgataaaaagcaaagaggttgctgattaatcccgaatcacttactaaggtaagtgattcgggtaaacaaacacagccatcttctgcgtcatgctttttttctctgtccggaataactccagtgcagaaagtgtgatacatcagtcctgttgatgatggctcctgttggttatacggtaataactcatgacttcacactgtggtttcttttaacaaatcgacagccagcatttccagctggttaaccacctcattactggatcgctccattctgtcgagttcttgcgacatcgcattcatatcgcctgcggcaaaatagttcagcgcagagtgaccagcggtatgcacctctttatgcggcgcttccagactacggaaactgtagtaattgctaaactgctgcccttcaaaaccgtagtaccatttccccagccgacactgatcgtgcatcgttattttactgtttatgtctttatttaagagtaatttgtagacttccattttccagataacatggtcaactttgacaatattcaaaaactgcaccgtagagatgtactgcatgaccgatttcatgctcagcgatttatcaatgacgatgccaatagactccacaatttgatttatgttagtcgtaatattatcaataaccggctgttggttatccagcacctcactcactctggccgtattatctttgattacagaggttaacgtactgacgcttttcgaactgtgtttaacatcttcggacaggtttttcacttctttcgaaataacgctaaaaccacgcccggcatcccctacgcgcgcggcctcgatcgcggagttaatcgctatcaaattggtctggttagcgatcttctgtatctctttaatacacgcattaatttgcgttaaggaggtatttaagtcgcccatacgacagccaatatctgatgaagtcgtgccaatttcggtgataaattccacgagcgattttaatgaacttctggctttatcattctgttcgttaagttcattaatgcgttctttttcaatattgagctgctcacaggacttaatgatggcattacgaatgatatcgatcgtcgagatccccatcagaattttttgacacagtatccgctcataaggctcaggagtatccaccaccacgtcagacgcattagcgccagattctgctggcggcggtatttttacaacattattattccagtggcgcaagcctaatacttttttaaacatataccattctccttattatatgtggacatcctgatctatgcctggataaagtattatcaactcatgctaacataatgaaaaatcggctgtcatctgccataaccatacgttcaccagaataagacaaaatgtccactaaacttaaataattacagagtaaactattcaataataccattaatagtcataatggaagtcgcttcactttatacgaaaatatcattcacaaggctgacaataatagttgaataataattaactgcatttacttaggtgtatctatatctcgttccgaagattgcagacagggtttaaacgcaaacttttgcgatagaaaaataacctaacgtaaactttttatatgactaataatgtcatttgaactcgtcaatatattatgctgtccgtttaccagccaaacaggcatgaccgaaatccaaagggataggggcggcgtaaccagccgcaaaaagtaccgattagacgaaaatcaggaaacgagtgcgccaacgcagcgagcgtcaccgcctgcgttagaaaagttaagaataatttgtgatattatttctcatatgttaccagtaaatggcaagctgacagccgttcgttggtaaacacaacaggcgggatatcggcgccaacgccgatatcccgacgagaatgaccccgttacgctttgatgacgattaacggttcaatatcgctctcttttttaatgactaatgaatcatcgccgcgcaggcacgtaccgccgtagttaccgcccacggtaaacgtacagacctgaatatacttcccggcgaccttcggcaggcaccacaactgctgatagatatttttctgcgtggcgaacttgccgctggttttatccaggagttcttcctgatggctcaccaaatcaatattactaccgcaacgtccggcaatcggttttaccgcatagccggtctgcaccagctcatcgttaacggtaaaatccgtgtcgagcaaatagcgatgatgtgggaagagcgaccacaggatgggcaggatcgctttgttacccgggatcaccgtccacagcggttcaaacaccaacacttccgggcgcagtaatacatcaatcagccggacttcattttccgggtgcccggtacgaataggcactgcggcatactccgtctcgctgacttcgcgtatctgctccattgccgtttcccacgcccaggttttccagacacaattcaccagccgtccgtcgccatcgatcaactgcccggcgtcatcccagcgcaactcgcccagcccgcggagaattttgctcgcgaaaccggcctgatgcagcgcctgctgcataaactgcgcgtgatagtcctcctcgatatcatcatcctgcatgatatggacgaaaggacgcgctttactgtgtttccaggcgcctgccagctcgttaattaagccctccgccgggttatgccctttaccggtatagccctgctcagcccatttttcgagaattaatcccgcttcggtatggcatgatgcggaatcggcattgtattcatagactttcagcccgcgttcatccatgcagaaatccatacgaccggtgatcatatggtgacgacggcgctgccaggagagacgcaggcgcggccaaagaattttggggatatcgaatagcgccagcagattatcgtcttttaaaactttgtccgtggcgtgcaggtacatcaaatgcaactcattggtcgctttgataagctcctgttcggcgctctcggtgatggtaaaatactggtacgggtcctgattgataacgtgtccgttcgcctgtacataggctttttgtaacggatcgcgctcatccagccactgaccgtcaaactgacctttctctggcagccttgcgccgcgaatcgccagcgactgattcgcgatgtcaggctgtgacaaactgtattgcgtgtcgtcggtctggatcatccagcctaaaatcgtcgtgtcatcaaaggtgtcgcgcagggtgtaacacccgttttctacgaccatttccagttcgcgagtccactgctgccctggcggcaatggcgtgtggataacgttttgctcagcaatgcgaattttgttatccaggagttgggtgataatcgcgacgtgcccggtttcgttaaactcgccgcccttttgccagatgagcaacgccccggcctccggcgcgcgcggcgaaccgttcgggaaggcctgcaaaggcaaaatattgtcattcacgacctcgcgcagaaaacgcagcgagaaaatttcccaggccatgccgacgtcagtaaaaacaacgccataattcagaaagagaaaacggcgggcaaattccacgcactgccatttatgccccatgtattcatcgtcgatgtagctacgaaaagctgcgtcgtcgtcgtcccacggatcgagggaattgtaatctgaagagtagatcgctacgccgccgggggcgtaacccaataatgtcccgaagggggcatcctgactggtggttcctttgctcatgcacttacctcaaaacaagaccgcctgagcagcctggcgtgatttcgctctgattgtctgctctgtgacactaaccggacagaggtcgacataatcatacacctcaataaggcacactgaggccagaaggttaaaatttcactcgtcggaatgtcccaatcggttaaatgtccggttagcaagctgctacactgcttcaacaccaccactgtgaaggcaggtcaatatggcagataatacttatcaacccgcaaaagtctggacgtgggataaatccggcagcggcgcgttcgctaacattaatcgcccggtttccggcccgacgcacgacaaaacgctgcccgtcggcaaacatccgttacagctctattcgctggggacgcctaacggccagaaagtgaccattatgctggaagaactcctggcgctgggcgtgaccggcgccgaatatgacgcctggttgattcgcatcggcgagggcgatcagttctccagcggctttgttgacatcaatccgaactcaaaaattccggcgctgcgcgataactcatacaacccgccgattcgggtttttgagtcgggcgcaattcttgtttatctggcggataagtttggccatttcctgccgcaggatctggctaagcgcacagaaacccttaactggttgttctggctacagggcgcggcgccgttcctcggcggcggtttcggtcacttctatcattatgcgccggtaaaaattgagtacgccattaatcgcttcaccatggaagccaagcgtctgctggacgtgctggataagcagttagctcaccacccgtatgtcgcgggagaagagtacactattgccgatatggccatctggccgtggttcggcaacgtggtgctggggaatgtctatgatgcagcggagtttctggatgccggaagttatcaaaacgtacaacgctgggcgaaacaggtagccgaacgtccggcggtaaagcgggggcgcattgtcaaccggaccaacggcccattgaacgaacggcttcatgaacgccatgacgccagcgacttcgaaaaccataccgaagataaacgtcaaagttaaaccataatgccggatgaggtagtaatgtcgtcatccggcatggtattccctgctgacgcttcgcttatcagttctgcgagtgcgtcatatgcggcgcttcactaaacccatgttgcatgagaatcaacctcgcccgtgctgacagtaaaaagtcggcaagcgtttttccctgctcgctcaggcaggcaaagccatattcagccacgggattataaggttccgggatatcaaccactcgcagcgaattaacctgccgtagcctgggagcatagctggcatagccgataaagatatcggtgtaatcatgattgatgagccattccgccgccagccggcccgccggtaacggcaaagtctgtctgccgccaaccagcgctaccgcgcgttttcggatcgcttcgccctccttgcccatccgcgaaaaaagctgctgcgtataatcgccggaaggatcgcaacctgctgttgaggtgccgatccgcagatcccgccgggttaatagcgacagccagtcctcgccttcacgcatcgcctgtgcccgcacgctcagacacaaacggttcgtcgtaaaaggcgcgacccgcagtgcccgcccgctttccagcagcgcctgcggatgcgccaggttcgccgaagcaaaaaagtcgcatgcttcgcccgcttcgatgcgttcacgtaacagccccgccggaccgaaatcacataccgcatccgcctgaaacgccgtcattagctgcggccagacgacgcgcaagctccccgcagccagtattcgcatcactgtacgccctgatagtcagtacggtaaaaacgttgataccagtcgttagcggccttttgcatgtcaatatcgtggaatttttccggatagagttttttcgccatccatagttcgccgattcccaccgcctccggcatcggatatccccaggctttggcataatccggcatcaggtaaacccgatgatgcttcaccgcgtcaatgacctgccactggggattgtgcaggatctcattgacgacctttggatagcgattctggacaaagattacttgtggatcccaggcgatcacctgctccattgtcacctgcttaaagcctttcgccgaggatgccgctacattcagcgcccccgcatgggccatcatcagaccggtgtatttaccggaaccgtaggtggtcagctccggattcgccatataggcgcgaactcgctcattttcaggaaccgactgcaaacggtcgctgaccatcttgcgacctttattcatcgcctcaatcagcgctttcgcctcctgcggtttattgacgatatcgccaatcagcgttattccttcacgcagcccgcgattataagcctgctcttcatcggccagggtcgggttcattttagcctgctcgccagcaacatcatggcgcagcgaaatcgccaccaccggaatgccaagacggctgatcttgtcgatcatctcctgcggagcgtaattcgtgacaaacaccacctgcgggcgcagcgccaccagtttttcaggatcaacgtgcgttagatcgcccagcgaggctttttgcgccagttccggcgccagacgcgcatagccgtcgcctaattgctgtttccagttcgccatgaccccaacgattttgtcagtggcattcatctgtacaaggagattgagcgtttgatgctggagcaccaccactctgtcgagggtatcgggaaccgtgacctggcggccaagttgatcggtaaaagtacgcgccgcctgtgacattaacggccagcaaaaaagcaacgccagcagagagagctggcgcaaaaatttattcataggtttcgccccacaatcgatatataaataattatacaacgattatagagcgatataatagaggtgattaagggatcacgcgctggtgatgtcgtactccatgcggcgcagcgcatctaacgtggctttcgcttcgtcttcgtcaatgatgctcatcgcaaaaccaacgtgtaccaatacccattgccctatcagatcggctggcttaccttcacaaatcagagcaatattgacatcacgtttgatgccacacacttccacctgcgcaagctggtgaatatcatctccgacggccagcacctgaccggggacgccaatacacataattaaccacctgaaataaaatgcgggttattcgacctcaatactttttactttcaacgaatcgccggtatccacccgcaggcgatcgccatgacaatgcggacattgcgcgtcatgcctgagaatttccaccacctgactgcaatcccagcaccaggcctgggccggtctgtagtcgatgtgcaattcgcacccttgcgctaaagtcccctggcaggcgatgtcaaagctgaaacgaaccgcgcgctcttcaacgcacgaaagcgcgcctatctccagccatacgccggtgacgcgcgccacgccgtgctgttctgcctgctgctgaataatttcaacggcgctttggcaaagagacagctcatgcattctcacagctccgacggccaaacagcaacgcacgccggcttgtctgcggcgcatcaggattgcttaccggcagggataacagcatccgcgcgcagtcatccgccagccggacgccctcttccggcgacaggctacgggaaagcggcgacatcaacgagcaggcaagatattgtgaaacgccttccagttcgccaacggtaaaggtcatcgtgccataaggcagttgcagaccgagtttttcaccgacggtacgcccgggccagatctggtccgggccagggaagattaatgcgcttaacatccacggcgtaattaccgtgcccgtccattgtccttcaaacaacgtaaaatcagagacatgcacaggcatagtcggatgcagaaacgaaagatcgtgcatcgaacgatgggctatctcttcaaacgccgcctgaacccgggcgacgggcgccgtgtcgaatccggaaaacgtttcagacatgcgccgtctccttaggaattgcttcgacgccggattcacgcagcgcagcaagaacctgctcaagcgcaggttcaatcatcgcctcgacggttggcgttaagccgatgtgcggttccagcgactgtggaataacgccgaccagggtcaacttcttcggaaactcgccggtaaagcggagggccgacaatacgtcggccagtccaagctgatggggggagattttgttggtgaacagcgccggaacttcatcgtcgcgcagtaccataatggttcccggcgcgttctttttcgacacgatggcgtcggcaatgatcaaatgatcccgattcgccatatcgccaagaagttccattcccgccgtaccgccatccagaatctcaacgaaatccgacagggtgtatcgttgctctaacgcttcaacaatacgtaccccgatggcttcatcggtcagcaaaatattgccgacccctaagactaatatccgcattacaaaaccttcaccgagaccacttcattgccatcggcgtccaccacgtgcaccgcgcacgccatgcaagggtcgaaggagtggatggtacgtaccacttccagcggcttcgccggatcggcgatcggcgtaccgaccagcgactgttcgtacggccccacgtcatcgttgaagttacgcggacctgagttccaggtcgatggcaccactgcctgatagttactgataataccgtctttaatcaccatccagtgagacagcataccgcgcggcgcctccaggaagcccacgcctttgaactcgcccgtcgcctgaatgttcggcttcacaaacgtggtgtaatcgcctttgccgatatttacaatcagcgcgttgtattgatcctgcaatacgttttgcagttcacaacagtgaacggtacgcccgatgatacgacccagcgtagagtgaagttgcgccatttccagcgttttgccggtcagcttctgataaagcgcaatgatttcattgagcttggtctgcgtggattcacgacctgcggccagtttacatagcatgttcgccagcggcccgacttcgacggttttgccgtagaatgtcggcgacttgacccatgagtatttaccgtcatccgaccaaccgtcgtaagccggaatcgtggtgccttcccacggcgcctgcggcgcttcatctttataccaggcgtgcttcgcgctctcctgaatacctttaatcaggaattcatcggagtgagaggtgatcggacggtatgtcgacagatcggcattggtaatgtaaccgcccgggaacaggaaactgccgtttttaccgtcggtcgggaattccggcgcgctcaggtagttcaccgcgcctttgccgcgctccagccattccggatagtaggccgcgatgactgcggtatccactttatacacctgctcgacaaaatcgctcagcttatcgataaacgatttgatgtacatcaggcgttcaaggttcaacgtaccgatgctgtcgagattgatcgggttcgccaccccaccgaccgccaggttctggatatgcggcgatttaccgcccagcaacgccaccacgcggttagcgtcacgctgacattccagcgcctgcagatagtgggcgaccgcaatcaggttgacctccggcggtaactgcattgccgggtgcccccagtagccattggcgaaaatacctaactgaccgctagcgacaagatccttgatcttgttctgaactttcgtgaactcttgcgcgctgttcaggtgccagctcgacacgccatccagcatcgcagaagctttttccggatcggctttcagcgcagaggtaatgtccacccagtccagcgcagagagctggtagaaatggacaatgtggtcatgggtggtatgcgccgccagaataatattacggatatactgcgcgttgacgggaacatcaatattcagcgcgctttccgccgcacgaacggaggagatcgcgtgagttgtcgtacaaacgccgcaaatacgttgcacaatcatccacgcatcgcgcggatcgcggttcttcacgatctcttccataccgcgccacatggtgccggacgcccatgctttggatacgacgccgttctcaatttcgcagtcaatgcgtaaatgaccctcaatacgggttaccggatcaatagtaattctctggctcatgctttgctcgcctcatgacgattatgatcgttttgttttaaaggaggaagtatcggcagtagacgaatgagtacgatgtatgcacaaatctcaatagccacaaaaccaatagaaatcaacaattcttcccaggttgggaagtagtggtagccgccacccgggttgaatgccaccagcgaataggtcagacgccacgtcgcgcaacccaacagcgcgctcagcgccgacaggtacagcatacgagagtcattacgcagtttcgccacacgcagcaccactaacgggaagaccatcaggacgacttcaatccagaacatagcggagtaaaaatcgccggcaaacgcataggacagcttgtcgcgataaatcagttcgccaaagcgcaggacgacgaaaatcgccagcagcacgctgatggtattcgtcagcttaacaaacaaatttttctcatccggaccgtttcctttcaggcctgcctgaaccagcgccccctcaaatatgacaatggagaagcccatgataaacgcggtcagaaccgagaacagcggcagcatttcatagctttgccatagcggatgcactttatagcccgccgagatcatcaatgaccccattgaggactggtgcatcgtcggcagcagcgcgcccagcgcgataataaagaacatcaccttattcagacgcttgagcgacactttccagcccagacgttcaaacaaggcaggcgcaaactccagcgccatcacgccgatgtagatggtcatacagaccgccgtctcaaacagtaccgagttcacgttgaagtgacctggaatgtagaagtacggcaggttccagtaacgaccgacgtcgatagtgatcgacaggccgcccagcgagtaaccaaacaagcttgccagcaatgccgggcgcaccaacggatggtattgcccacggttaaagacatacaccgcccatgccaacgcccaaccgccgcaggcaaagccggtgccgatcaacaggtcaaaggcaatccagacgccccacgggaaaccgccgttcaggtcggaaacggagcccaacccgaagaccagacgcttcacgataaggagcatacacaggacgattaacggtccaaaaataatgaccggtttactgatgatttttccgcccagcggttttggatcatgactcatgatcgtctcctccatcgtgatggtcgtttttgctattacgacgaaccagcacggttaagcccgccagcgcagccaggggtagtatcatgcctttataaagcgtgtgttgaacatgctcggagcgcgctccggttgaaaggtcatccagcttcggcagatccaaatcttcataaggaacgcctgtcagcaccagcacctgagtaccaccgccctctttttcaccgtagaggtgtgggtagtatttaggcaccgtatgcagataggtgtcgtccgttttcaacgtctggcgcggatagtgatattcactgcctggtttgagggccagacgttttttcgcttccgccattagctcttcacgagtaccgaaaatgacggcccctgccggacaaacttccacacacccaggcaaaccgcctttatccagacgctcaacgcctttctggttacacaactcacacttgtgaagcgcgccaaacgggttgttgtagtcgtacttaggtacgttgtacggacaggcgaccatacagtaacggcagccggtgcagacatctttgtcatagtggacgatgccggttttcggatcttttttcagcgccgacaccggacaaacggaaacgcagttaggatcgacgcagtgcatacactgtttcttgatgtaggcatagccgttctcttcctgatctttgttcacgcccgtgccgctacgccatacctggataatgttattggtatacggcgacagtttgtcgttgttcgaccaggtctgctccccttccgggttacgcgccgggaagttgatatcctgacactttgtgacgcaggcctgacagcccacgcacagagtggagtcatacagcatgcccagcgaacctggaattggcggacggttttctgcagccgcatggctgacagacggcgcggcgcccaacagcaatgctccaccggaggctgctttaataaagtcacgtctgttcacggttattctccccgtgagtcagcgttatctttcttttgctgacgccccagttcacgtaccgccatcacgctgacgccggcaaccagaccgactacgccgccaagcagaccgacagcgcccgcagagatattgccgccttctttcatattgacgtcaggtttctctgaacgcggagtttggttttcgacatgagcaagctggtgaatgcccttatggaagccgataccttcttcgttacagccatagcaaggatgaccgatcgccactggccagacgccgccaacgtcacagaactgtaatgtagaacagttgccccaggtttccggccctttacagccaagatggtagaggcaccagccctgacggtggccttcgtcgccaaattctttggcaaaacggcctgcgtcgaagtgtggacgacgttcgcaatgctcatggatcagacggccataggcaaaggttggacgatttttcgcatccagcttcggcggcgtgccgtaagtgatgatatgcgcgacggtcgccaggaagttatgcgggtttggcggacaacctggaatattgataaccgttttgcccggtaagacttcctgcagactgacagcgccggttgggtttacgccagccgcagcaacgccgccccatgccgagcaggaaccgatagcgataatcgcggctgcgccgtcggcggctttgcggatgtgatccacgatcggctcgccggcaaccatgcagtagataccgttatcttttagtgggatagaaccatccaccaccagaacatattgccctttatacttctccagagcgttatgtttgttttcttcgacctggtgaccgaatgcggcggaaagtacctcgtggtattccagagagatagtctccagaacgaggttttcaacggttgggtgtgtagcacgaagcagtgattcggtacaaccggtacactcctgagcgccaatccagataacgggcggacgctgtggattggataccgattctgccatttctgcggcggctttgctactgagccccatagtagcggccagtgctgcacaaagcttcatgaaatcacgacggttaatgccgtgagaagtgatgagagtattatctccagtcattttatagttattccgttacgaagacctagcttttattttgcactgttcgcgaagaagttattgcgatcggtacgccatttaccacactttttttatggttatgtgcgccataatacttcgacggaacagtaaaacgaagggaagaggcgatagtgtaattaattaaagcaagataatacccctgttggatcaaccttcgagtcgataaccagccataaagaagcgaaccgccatcccggaatgattctctttaaagaaatccatcaccatttctttatccagaccatagcgacgcgtcagaattccggcctcccacgcgctaagttgacgatcgccggtcttttcgaacatacggtgtgtaaaacccaatacaaagccacgtttatactcagaacagaaattcaccgcatgatgcgcgctatatgcatatggcgcgtgcaacccggccattaaccctttcccaaaatgattattcatctgacctccttagtcgctatataataaattatatagcaactggttaaatgaaggccagcgcattacgcgcttttttgcttcacatcagaaggcaacccattcatcagtagactgtgcgggagccgacgccattctctgaacgccaggcgccgctttcgtcgttacgcgttgttgcggctcactagcggaaagccggaactgctgtacggagcgttgcaaatcctccgtctgccgttccagcgccgccgccgcggcggaaacctgctcaaccagcgcggcgttttgttgcgtaacgctatccatttgcgtgatcgccacgccaacctgagagatacctttactctgctcttcggaggcggacgcgatctgtttcataatcgtcgtcacttccgtgacgccgcgcaggatggcgtccatcgtcgcgccggtctcctagaccaactgcgcgccctgcgctacgcgacgtgccgattcgccaattaaagcttcaatttctttcgccgcccccgcgctgcggctggccaggttacgtacctcaccggcgaccaccgcgaagccgcgtccctgctcgcccgctctggccgcttctaccgctgcgttcaaggccagaatattggtctggaaagcaatactattaatcacggtagtaatttcggcgatctgctgcgaactggcggaaataccgttcattgtttctaccacatcggaaaccagttcaccgccttttcctgccgttagcgaggcggcatccgcaagctgactcgcctggcgagcgtgttcggcgttcatttttaccgttgcggtaagctgttccatgctggcggcagtttcttccagcgcgacggcctgttcttccgttcgggaagagagatcgttattaccggtagaaatttccgtcgcgccgcgccagatattgtcgcttccggcgcggatcgtactgacggcttcgcgtaaactgtcctgcatcgcgcgcagtagcggcaccaaccggcctacgcagttacgccccaacgcttcaatcggctggctaagatcgccttgcgcgatacgctgaaactgctgacggatgcgctccagcggtttcaccatcattgcaaccaaatagcgatcggtaaaaatcaggatggcaatgcccagaatcaccgccgtaataagcaggatgcggatggtataggttttaccatcgaccatcacacgggtgttatccagcatggcgccagcttcatgattaaaccgttccgcgctggcgccgaacgcgcggctaagtgcaggcgtgaccgtactggcatgttcgctccaggcggtcagcgatccttgctgcgccagttgcatttgaggaatgacgcctttctccagcaaggcctgccagttggacaacaccgcccttgagatatcagggttcatcggccctggcgatagcgctttcatctcctccagcttctgacgcatattctcgagcgactgccgggcgggcgcaaaatcgggcgtgccgccgccgatttttacatccatcgcgcggctaaggcgggtaacaaagcggaaatattgatcgttaccctggcttagcaccgtcatttgccgcacaagatgccggtcaatatcatttccttccgaaacttcggataaagcatggacgctgtataaacccacccccgaccagagtagacaaaaaagtcccagtatcgtcagcatgaccatacgaatagtaaagttttgcagcaaacgcatatgaatttccttgctgaatataagagattagtcatcagacgatgacgcactctcgttatcggcaaggcgcggagaatatataatgcattctccatttttttacagttatcgccgtttacgtacccgtagatgttatatatctgtgaacgcagagaaaatctttcagtgttattactgagtaaatgaatagatgtagtaaaaatattgcgtaaggctgcagggagacggttatccaccgttaaagaagcgctgttttacagccgggctcagcgtcctttgcccgactgccccgccgtggacggcggctcaatggttatgtcgcgtcaatctgtccagatagcccatcacgaacgccgacaggacaaaggtcagatggatgatgacataccacattaatttgttatccgggacgtttctcgcatccataaacacgcgtaacaggtgaatggaagagatagcaactatcgatgccgccaccttattttttagcgacgtcgcatccattttccccagccagttcagcttctccttgcccgcagagatatccagctgagagacaaagttttcatacccggagaacatgaccattaccagcaacccgccgaccagcgtcatatcaaccagcgataacagcaccaggatcagatcggcctccgccagggcaaaaacgttcggcagaacgtgtagaatttcctggaaaaattttagcgctaaagcgatcagcgccaaagagaggccaaaatacaccggcgcgagcagccagcgagacgcatacattacattttcaagaaagcgttccatagggacctgtcaggtaactaaaaccagcaacagtatatctcaaccatacaacatcagatcaacatgtcagttaaatctcatccggtttaacctgtgggcgctgatattccggccataccagcgcgaccaacgccgggtaggcttcaagactgaactcacgaaaacactggcgtaaattaaggacgtccaaatccgaatacggcaccttttctccgttcagacaacgcttctttatattgtcgtaatacttataaacggcagagttaaggtcgctgcaacgacgctgtgcgtcaaataatccaggcgtttcattcaactcagtcattgtcattcgttttatcgttgcatgaaggaaatcgatatattcatggttaacgcgccagtaccataccggcgttatcgaattcattaatactgagaaatgatcttcgccctcttcctttgtcatgggttcagtttgatttaaatttacggtttttccaccaggacgttttttattaacctcccacatcaggaagagtatcgcgccggtcagtaatagcaatataataacagaataaaaaatactgttcatagcaggctccattttttttgattttaaaattacaccatgttattgtcaacgaaacctacactattaaaaatagtataccactgatcgtaaaggatatttagtcatgcttcctgagcatctggtttcctctcattttcgcctgtcatcgccgccccctgaagccacagaaaacagtaaaaatttgtctcagggaaagacaaaactcagcgattacgagcccgatattttaatttgcgctaacgcaaccgggcaacacagaaacgtattatttgaagaacgcgaccgtcatattaaagaacgtctgtattgtgtggctaaaattgaaacgtttgcccgcctgataaacgcactacaggcagaaggcgatattgatgcccaaacgctaagtaaaatactggcggataaaaccgcaatgataaatgaaaaaggtaatgccatttggcttaatttaatcactcgcgaaaccaatatgccgctattttattcactggaagataaagatgaaagaagttgaagacaataacgtttatttggctttagacaaccataaaagtgatgaatttatcttaaagcaaaatcttgcagcgctaatcgccagtaaaaatgccactctggaaaaggtaacgcaggaagtggtatccataccggcggcgttagtgcgcctgaagtggcaaaaccgacgagagatgtatgcgttacaggtcaaagaggagatttatggcgcgaccatcaatgctattatcgagcagcatcctgaattacgagacaaaattatgtctcgtcttgaaagtgactggcagcatctgctggctcgcgagacggcaaccttacgtctgacgcgtaagctttccgatggcgactaccggacgcgcaacgtcaccacagtcgcacggcaagaaaaataaccttcatagctagttaactctgttgtgaatacgggcgaagcataaggatcgttctgattctccctcttacggtagtaaaagtgtctacgcttaaagggtgttcaacctgaagggagaagctcaatgtctcatctatacgaccctaccacgcagtattacaccggcgagtatcctaagcaaaaacagccggcgcccggcgtccaggcgaaaatgacgcctgttcctgactgtggtgaaaaaagttatgtcggcagtggtcgccttaaagatcgtaaggcgctggtgacagggggcgactccgggattgggcgcgctgccgctatcgcttacgcgcgtgaaggcacagatgtcgcgatcaactatctgccagcggaagaagaggacgcccagcaggttaaagcgctgattgaggagtgcggccgtaaagcggtgttattgccgggcgatcttagcgacgaatctttcgcccgttcgctggtccataaggcgcgcgaagcgctgggcgggctggacattctggcgctggtagccggtaaacagacggcaatcccggagataaaagatctaaccagcgagcaatttcagcaaaccttcgccgttaacgtttttgccctgttctggataacccaggaagcgattccgctgctgccaaaaggcgccagtattatcacaacgtcgtctatccaggcctatcagcccagtccgcacctgctggattatgcggcaaccaaggcggcaatccttaattacagccgcggcctggcgaaacaggtggcggaaaaaggaattcgcgtgaatattgtcgcgcctggccctatctggacagcgctgcaaatttccggcggccaaacacaggataaaattccgcagtttggccagcagacgccaatgaagcgggccggtcaaccggcagagctggcgccggtgtatgtctatctggcaagccaggaatcaagttacgttaccgcagaagtgcacggcgtgtgcggcggggaacatttaggctaacgcatgaagtcgattaaggtggcgcaattctgttaagcaaggcgccatcttaggcaataaaaaagccgggtggcgacttcgccttacccggcctacagcatcagcagaatacttatttcgctttcgcggtctcttcgccgaccaaaccaatcttgagatagcccgcctgatgcagcatatccatcactttcatcagggtttcatactctacggttttatccgcacggaagaaaatcgtagtatcctttttcccttccgtcagggccgttagctcggcaatcatcgtatcatccgtcaccggatcgttaccgataaacatggtgttatccgctttcaccgacagataaaccggtttttccggacgcggctgtggcgtactggtagaagcgggcagattcaccttgacgtccaccgtcgccagcggcgcagccaccataaagataatcagcagaaccaacatgacatcgataaacggcgtcacgttgatttcatgcatttcgccgttgtcatccaggttctcgttaagacgcattgccatgacgcattaccctacccgtaatttctgcgcggcgcgtaccggctgcgcactggcgctcgcattcagatcaagatcgcggctttgcagcagcaatacctgcgccgccacgtcgcccagcgtcgctttgtaactgcctatctgacgtgcgaagatgttgtaaatgacgaccgccgggatcgcggctaccagcccaatcgccgtcgccagcagcgcttccgcaataccaggagcgaccaccgccaggttggtggtctgcgtttgcgcaataccgatgaagctattcataatgccccatacggtgccaaacaacccgacgaagggggaaatggcgccgatcgtcgccagataaccgttgcctcgtcccatgtagcggccaaccgctgcgacgcgacgttccagacggaagccggtacgttctttaatcccttcgttatcttcgctgccctgagagagttccagttcattctgcgcttcattgatgagctgtgcgctgaggctttttgcgctgaaacctgccgcaatgtcggaagcctgatctaaagagcgcgcatcggctaattgcagttgttcgcgctttaagcggcgcttttgcgtgaaaaattcaacgcttttactgaagaagatagcccaggtgacgactgacgccagaatcaaaccaatcatcacgcacttcacgacaatatcggcgtgctgatacatgccccagacggaaagatccgtctgcatcaaattattacccactctgtatctccaggacgcaaatcacaaaatctgagcataataatatcaaaacaacgtcgaattgatagtcgttctcattactatttacatactgccgcacctttactgctttttctttgcgcttacgcattaaaaaagccacctgtttttattttggcaaaattttcatctgtatcacacatcgccagggtgcagatggttatattcatgctagtttagacatccagacggttaaaatcaggaaacgcaacatgacggataaacagttggataccaaactggtaaacgcaggacgcagcaaaaaatacacgcttggctcagtgaatagtgtgattcaacgcgcttcttcactggtgtttgacaccgtcgaggccaaaaaacacgctacccgcaatcgcgccaacggcgaattattttacggacgccggggaacgctgactcacttttcgctccaggaagccatgtgtgaactggaaggcggcgccggatgcgcgctcttcccgtgcggtgcggcggcggtcgccaacaccattctggcattcgttgaacagggcgaccacatcctgatgaccaacacagcctatgaacccagccaggatttctgcagcaaaattctcggcaaactgggcgtgacgacaagctggttcgacccgctcatcggcgctgatatcacgcaacatattcagccgaacacgaaagtcgtatttctggaatcccccggttctattaccatggaagtacatgatattccgaccattgttagtgcggtcagacgcgtcgcgccagacgccgtcatcatgattgataatacctgggcggctggcgttctgttcaaagctctggaattcgatattgatatctctatccaggcgggcactaagtatctaattggtcattctgatgcgatggtcggtactgccgttgcaaatgcgcgctgctgggaacaattgcgggaaaacgcctatctgatggggcaaatgctcgacgccgacacggcttatatgaccagccgcggtctgcgcacgctcggcgtccgactgcgccagcatcaagaaagcagcctcaaaatcgccgcgtggctggcgaaccattctcaggtcgcgcgcgttaatcatccggccctgccgggtagcaaaggtcatgcgttctggaaacgagactttacaggcagcagcggcctgttctcctttgtgctcaataaaaagctgaccgaggcagaattatcagcctatctggataacttttcgctgttcagtatggcctactcctggggaggctacgaatcgctgattattgctaatcagccggaacagatcgccgcgattcgtcccgcaggcggcgtagattttaccggtacgctggttcgagtgcatattggtttagagagtgttgatgatttgatcgctgatttagccgccggcttcgccagaattgtgtaaagttgccgtggatggacatatatgcagacaatttccgtggaaaagtctgcgtttgttgcgtccgggatcaaggcatcccggacgattcaggagtacaataggcagataaaagcgtaaatgctgttccacaggaaagttcatggctgtcattcaagatattatcgctgcgctctggcaacatgattttgccgcgctggcgaatccacacgttgttagcgtcgtctactttgtcatgttcgccacgctatttttagaaaacggtctgctgccagcgtcattcttacccggcgatagtctgctgctactggcaggcgcgttgatcgcccaggatgtgatgcattttttgccgacgattggcattctcaccgccgcggccagtctcggctgctggctaagttatatccagggacgctggctcggtaatacgcgtaccgtcaaaggctggctagcgcagcttccggcaaaatatcatcagcgcgccacctgcatgtttgaccgtcacggtttgttagcgttgcttgccgggcgctttctggcgtttgtccgcacgctgctgccaacaatggcgggcatttccggcctgtccaaccgccggtttcagttttttaactggttaagcggcctgctgtgggtgactgtcgtgaccagcttcggctacgcgctcagtatgatcccgtttgttaagcgccatgaagaccaggtaatgacatttttaatgatccttcccgtcgcgctactggtcgccgggctgttaggtacgctggtcgtggtgattaaaaagaaatactgtaacgcctgacgtatccataatcggccaggatggcccggttacgcttcgttgccccgtggcgggatgccccacttagctcccttgcattgtccgcattcttgccgcatcttcgcccggcgtaacgccaaaataacgtttaaactcccggctaaactgcgatgcgctctcatagccgacccgcatcgccgcggcgctggccttcataccgtcgtgaatcatcatcatccgcgctttatgcagtcggtagctttttaaatactgcaacggcgaggtgctggtgaccgccttaaaattatggtgaaacgccgacacgctcatgttcgcttctgccgccagttgctcaacattcaggttctcggtgtatttcatttcgatctgtttaagtacgcgactgatcaggctaaagtgcgtctggcgactaaccagcgcaagcagcgccccgccgcgcggccccatcagcacatgataaagaatttcgcgaataatctgttttcccagaatccgcgcatccagcgggtgctccatcacatccaacaatctttccaccgcgcataaaatctcgtccgacagcgtggcggagttaatcccgctggccgccatcggcaactggaaacgctcatcttcgccaatgtccatgagcaactcttgcagttgcagcacatcaatgtcgagccgaataccggccagcggtacctccggcgtcgcccaggtctcgcattcaaaagggagcggcacggtcagtaagagatattcattagcgtcataacgaaacttgcgcttgttaatatagccaattttatggccggaaaagagaaatatgatgccaggctgatacatgaccggcgtgcgcggccccggttcaacaccatacaacagacgaatgcccgccagccgctcgctgattattttatcattattttttaaatgattaattttatcagccaactgtaagcaaattgcttcacgattcataacgcgccatttttttatcaaatccactccgctggattgtgcgcatttttagcgattttctccagcattctggagaaataggcaaaacattggcagaaatgtgcattgagagacatctctcacaagaccacaatgatgaccatcaggcagacagccgcctgccctctttttacccacataagggaatgagcaatgaaaaatttcaaattacatacccctacccgcattctgtttggtaaaggcgctatcgtcgatctccgcgatcagatcccgcaggacgcccgcgtgctgattacctatggcggcggtagcgtgaaaaagaccggcgtactggcgcaagttcaggacgcgttaaaaggactggatgttcgggagtttggcggtattgaaccgaacccgtcctatgaaacgctgatgaaggccgtgcagcttgtgcgcgacgaaagtattaccttcctgctggccgttggcggcggttccgtactggacggcaccaaatttatcgccgcagcggcgcagtatacggacggcgtcgatccgtggcacattctggaaaccggcggtactgagattcgtagcgcaatcccgatggggtctgtgctgaccctaccggcaaccggctcagaatcgaacgccggcgcagtcatttcccgtaaaactactggcgacaaacaggccttccactcctcgttcgtgcaaccggtgtttgccgtactggacccggtctacacctatacattgccgccgcgccaggttgcgaacggcgtcgtggatgctttcgtccataccgttgagcagtacgtcacttaccccgttaacggcaaaattcaggatcgtttcgccgaaggtattttactcacactgatcgaagaaggtcccaaagcgctgcaagagcctgaaaactatgacgtccgcgctaacgtgatgtgggccgctactcaggcattgaatggcctgattggcgctggtgttccgcaagactgggcgacgcatatgctgggccatgagcttacggcgatgcacggtctcgatcatgcccagacgctggctatcattctgcctgcgctatggaacgaaaaacgagacgttaaacgcgcaaaactcctgcaatacgctgaacgtgtatggaatatcaccgacggttccgacgacgagcgtattgatgccgccattgccgccacccgccgtttcttcgaacagatgggcgtgcctacccacctgtccgattacggtctggatggcagcactattccggcgctactggccaaacttgaggcgcatggatgcacaaatttaggtgaaaatcaggatattacgctggatgtcagccgtcggatttatgaagcggcgcgctaaggttttttcgcctctgactttcgtttttggccatttcgtccagacttaagtcacttagtctcgccggacccgactccggcgagccaattaaaagaggaacacatcatggctaatccaaccattatcaggctacaggatggcaacgtaatgccacaacttgggctgggagtctggaaagcaagcaatgaagaggtgatcgcggcgattcataaagcgctggaggtgggctatcgatcgattgataccgccacagcatatcagaatgaagaaggcgtcggcaaagcgctaaaagcagcgagcgtggcgcgggaagagctgtttatcaccactaagttgtggaatgacgatcaaaaacgtccccgcgaagccctgcaggagagtctgaaaaaactgcaacttgattatctcgatctctatctgatgcactggcccgtaccggctatcgatcactatgtcgacgcctggaagggcatgatcgcgctgcaaaaagaggggctggtaaagagtatcggggtctgtaactttcagatccatcacctccagcgtctgatcgatgaaaccggcgttccccctgtgatcaaccagatcgagcttcaccccttgatgcaacagcgccagctacatgcgtagaatgcgacgcataaaatccagaccgagtcctggagcccgctggcgcagggcggcgaaggcgtattcgatcagaaagtgattcgcgaactggcggataaatacggcaaaacgcccgcccagattgttattcgctggcatctggactgcgggctggtagtcattccgaaatccgtcactccttcccgtatcgcggaaaactttgctgtctgggatttccgtctcgataaagatgaattaggcgagatcgcaaaactggatcaaggaaaacgcctcgggcccgatccggatcagtccggcggttaagccggatttatcgcacgccatgcccgacgatgtcgtcgggcttttttgcattccgaaacattaagaaacaattacgcgcatttaacagtatatttcccccacacacaagcgcagaattattctgattttgtgaatatttattcacatttattatgaatttacttaatacatataaaatatttatggatgtgtgattgtggcggaaaaaaaatctcagggcgtcaaatggctcccattcattcttattctggttatcgccgccggactgtggcagctaacgcccccttccgggttaagcgcgccggcctggcattccgcgattatttttgtcgcgacgatcgcctctatcgtggcgaaagtgctgcctattggcgcggtcggtattatcggcatcaccgtctttgcgctcgcctatgctgccggcgacaaaacggccagcggcgcgattaccacggccttgagcgagctgaacagttcgctgatctggcttatcgtcgtcgcctttatgattgcccgtgggtttatcaaaaccgggctgggtcggcgtatcgccctacaaatgatccgtctgttaggtaaacgaacgctgggtctggcttatggcctggcgtttgccgatctgatcctctcccccgcgatgcccagtaacaccgcgcgctgcggcggcgtgatttacccgatcgccgactcgctggcgcgcagctttgattcacatccggaagatgagtctcgcagcaaaatcggcacctttctgatcacctgtattggcaatgttaacgacgtcaccgccgcactgtttatgaccggttatacgggtaacctgctggcggtaaaactggcggcgaacgccggcgttacgttgagctggggaagctggtttattgccgcgctcttgccttgcctggtctcttttcttatcgtcccgctgctggtctactggctgacgcgtccggaaattaaacatacgccggatgcgccggatctggcgcgcaaagagctggcgcaaatgggcagtatggcgcgcggcgagtggctcatgctggcgaccgtcggtgtgttgctggtgctatggatttttggcagctcgctcggcgtggatgccacgacggcctcttttgtcggtctctctattttattactgagcggcgtgctcacctgggaagacgttaaaagcgaaaaaggcgcctgggatacgttgatttggtttgccgcgctgctgatgatggctaaccagttgaaaaaactaggattcaccagttggtttggcaacctgattggcgacagcatcggcagtacgatgcatggaaccagttggataatcatcctgctgctgcttaacgcagcctatttttatacccactattttttcgccagcggcaacgcgcaaatcgccgcgctgtatgcggtgtttctgggtgtcggcctgcatctgaatataccggcggcgccgatggcgctcatgctggcgtttaccagcagcctgtactgctctcttacacagtatacccacgcacgcggccccattctttttggcgccggctatgtaccgacgggcatctggtggcgaacgggatttattatcagcctctttaaccaggcggtctttttgacagtcggcctcgcatggtggaaagtgttagggttgtattaaacgcttaacgcatcgataaccccctcggttaacggagaaatggaatgacctgcattttctgtcaaatagttgaaggtaaagcaccttgtcataaagtttgggaagatgagcatcacctggcttttttgtcgatttttccgaataccgatgggtttaccgtagtgatcccgaaaaaacattaccccagctacgcgttcgatctaccgccgcaggcgttagcggacctgatgctggcgacccaaaaagtggcgaagaaactggataaggctttcccggatgtcagtcgtacgggaatgttcttcgaaggtttcggcgtagaccatgtgcatagtaaattaagccccatgcacggtactggcgatttagcccactggaaaccgattgaatcgcggcagaataaatttttcgaacagtatgaaggatacctgtcgtcacacgatcatgaacgggcagctgatgagaaactggccgcgctggcggccagaattcgtgaggcataaatacggagcacttctgccggatggtgttcggcctgggtcgatctgtgggcctgataaacgcagcgccatcaggcaaaataattgctggatcgcggcttcgccttatccagcctgacaggatacctgtaaaaccgtttaacgccccgcgcctttcccgcgcttcttattagcagcaagcccctgccgctgatgttccaccggcgtatgcttggtcaacgccgggcgggtattgcggttctggcgacgcgcttcgcgcatctcttcaatagtcggcgcaggcaccagacactcacggcgaccgccaatcaggtgctttttgcccatcgcttccagcgcctggcgaatcagcggccagttcgccggatcgtgataacgcagcagcgccttatgcaggcgacgttgcctgtctcccttcggcaccaccacatcttcactcttataaccaattttacccagcgggtttttgccggtgtaatacatggtggtcgaatttgccaacggcgacgggtagaagttctgcacctgatccagacggaagcggtggcgcttgagccacagcgccagattcaccatatcctcgtcccgcgtgcccggatgcgcggagataaaatatgggatcagatactgctcttttccggcctgtttagagtaaaggtcaaataactctttaaagcgatcgtagctgcccatacccggcttcatcattttcgacagcggaccttcttcagtatgctccggcgcaatcttcagatagccgcccacatgatggcttgccagctctttaatgtagcgaggatcttctacagcgatgtcgtagcgcacgccggaggcaattaagattttcttaatgcctttcagctcacgggcgcggcgataaagattgatcgtcggcgtatggtcagtatccatatgcggacagatatccggatagacgcatgacaggcgacgacaggtctgctccgcacgcggcgacttacagcgcagcatatacatgttcgcggtaggaccgcccagatcggagatcacgccggtaaaccccggcaccgtgtcgcggatcgcttcgatctcgttgataatagagtcttccgagcggctctgaatgatgcgcccttcatgttcagtgatcgagcagaaagagcagccgccaaagcagccgcgcatgatattgatcgaaaagcggatcatctcataggccggaatacgggcattgccgtaagccgggtgcggcacacgctgatacggcagcgcaaacacgctatccatctcttcagtggagagcggtatggcgggcgggttgatccagacatagcggtcgccgtgtttttgcatcaacgcccgcgcgcagccagggttagtttcgtgatgcagaatacgcgacgcatgggcgtacagcaccttgtcgcctttcaccttttcaaaggatggcaacaggatataggttttttcccacggcttcggacgcggcggctgcacggtaatcgccttagcttcttgctttttcggcgcgaccggcttgttatccgcgcacggcagatcctcgccatagggatggggaattggatcgattttacccggcgtgtccagacgagtggagtcgacgccgctccagcctggcagcgcttctttaaccataatcgcagtgttacgcacgtcgcgaatctgatcgatggtttcgcccattgccagacggtgcgccacttccaccagcggacgctcaccgttgccaaacatcagcatgtcggctttggaatcgactaacactgaacgacgcacagtatcagaccagtagtcgtaatgcgcggtacggcgcagactggcctcaatgccgccaaggatcaccgggacatctttccacgcttctttgcaacgctgggtatagaccagcgtggcgcggtccgggcgtttgcccgcgacgttatccggggtgtaggcgtcatcgtggcgcagcttacggtcagcggtgtaacggttgatcatcgagtccatgttgccagcggtgacgccgaagaacaggttcggtttacccagacgcataaagtcgtctttgctgttccagtccggctgggcgatgatccccacgcggaagccctgcgcttccagcatacggccgcaaatcgccatgccgaagctcggatgatcgacatacgcgtcgcccgtcaccagaatgatgtcgcagctatcccagccaagttgatccatctcttcacgtgacatcggcaaaaacggcgccggcccaaaacaggcggcccagtactgcggccaggagaaaaggtcgcgatccggttggatcagggagatagcgctcatattgcttccaaaaaattggcaaaaaaataatcaaaggtcggggattataagctggaatggaagagaaatcgaattgattggtgaggctgcactctgtagcggggccgattgcctgccccgtcggttatcgtacttatggacgagcaggcatatctgctactttgataataggattttgttcttcgagcaaattcaacagtaccggcgtgacatgatacatggattctgcaatcatgactttccctcgcagggtgattttcttccctataaaccgttgataataattgtatttttcaggcggaagaatgagctggacatagcgatcccagtcaggttggtccatcatggcccctgccacacactgaaggtttattgtttttaattcgagatctttatccgagtgttggccttgattatcttcaatgacgtgctcgcgtttgaccatcataccttccagttcaatcgtgtcaccctctttgttgcaggaagaatcaaagttcacataagcgagaacatatttccctttcttttcatcaaactcaaaagtggaattgtaataaatacctaaaggttcgctgtataaaaaggagtagcgcttatagctctcgatatcgcgttgacagtttccgccgccattgatcattaagtctctgtatttttgccatactttttctaaattgattggctgatctgcaccagtcgtaaggtattctgccgtattgtccatgacatatttgatattattcgctttcagcgcctcacaaaaatcggttgtgttctgaatatacagcgcctttttacgctgtgactcaggagaaagcagctctttgaggagtttgatattacgatgctctgtctcggtaatgaggtaatcaacgttcgcatagcgtgggcgataccacggctgctgtcggaagtaccgatccatctcaccgcccggtctgaaaatataaccgtgacgagcataaatctcattaagcataattttaagatcggctatcgaggttgcgctggtttgcacgcttcttacctgaagccaggtccgcgaggcttcaggaaatcggccttccagcgtgatgtgctctatctgcggtgcaaaagcaagatagctgccgtaatccaacagagttcccttcgtccccatgggaatgagtcctttccttttaggcgtcacgagaaaatcgatacagcgcgtatgctcacttccagtaatcaccgaatggtcattctcttgttcaaaaaactggatgtcacaccacggcgcgccactcatcatagaaaaatcgtcaggaacaacgcgctgccattttcgaacgtcgggcaactcagcgtaaaacctgagccactcatctgcagtggcggtataatcatcgttttcgctgccataaaagggttcgcgactgtcaccgaaaaagataaagtcattaagcgtgtagtctgtgaccttgccctgaaaatagatttttttattttcgatctcagggcggaattttagttccgcattagctgagaagataaacaggcacataaatataaataaaaaacattttttcattatttaccactccctgtatctctcttaacaatcaatgtaattttaattatcagagcacggcatatcagtctaaatcggcgcactgctgtgctaattttatacgcacattggtacgccgcgtatcttctggtggatacaccttatcgatcattgcgttaagcttgttacagtccaaccaggccatccggtaggcagtcatcaggctatgcctttcatcctggtaatcaaggctggctacaataagggcttccgacaacgccgtatgttgctgttgcatactttgcagtatccccgccagaatatccggcggcagcgcgtcctctttcgaggctgtatgcaatgtgcgtgaaatcaggaaattccagccgtccgtcaacttatcctgagggatgtgctgccagttcagcatctgccctttcaccaacgcacgcagcgtctcgccatccgcatcaataaacagcgacgccagcagatttttattcggatagaccgactgccccagcacctgcggcgtcagttttatctgggcaagcagcgctttagtttgcccctgcaacaagaaataatatgcgcgatacagcggattttgcgcttcacgccgctgccagaaaaaggccagtgtctctttatcctgaagctgtatcgcccccgaataggcttcatcggtgaggagatcgggcatgacccgtagcagaatgtcggccatctcaaaaaaagtctggcgaaatccctcaggtttaaaacggggcgtggggagatactccaacggattttgccgccgtacgatggtgcgatttgcctgcgcctgcggggagtcgcccatgagctgctcgctaaaaatacgcaccgcagtgatattgccactctcaaaagcagcaaaaaatggcgcattgacgaaatagccatcttcccgcgagaacctaaaaggcgatgccacacgtgcagtcagatcgcgcaagtttttttctgatatgcctggcgcttttaccgcctgaaccagtgtctgttccaacgtactgttatcatgaatgctctctaactgacgcaggtcgcctgcctgaacctgcctgagcaactgcgcaatattttgctgttgccattgatagctaatagcacgccacagctccggcatcaccgggcacagcatcccaatgaacacaatatggcacagtagccatgcgggccacggcttgcgcagccaggttcccagcagcagcgcgggcagcaagcccgcccaactcagaatcggcaacaggagcatcaacatccataccgtgcctgtttgactcaacaactgggtgtactgcaacgtgggtaacagcaataccacgaatgcccactgtggtagtaatacccacagcaaaatctgtcggctgcgttttttggaaaacatcaggatcagcagtgatgccaccgcagcggcatacccccacggtagaacacaaaacatcagcagttcagagccaagccatcgattaatataatccatttactattcctttagtcacttcgcgactggacacagcgcattcagcctttgtcgcgtatcgtgtagtacttgttcgctccccactactaaagcattcaacacctcacgcaattgctcacaggaaagcccagcctgtaaaaaagcggcaggaaacgtcggtgtccagggaagatagtgggcgatttgctcgttggataacgctttctgcgcttgcatcgccttaatgatctgtatcagcaatgcgttctctaatgctccaccacgcagtcgtaatatggcctgatgcagaggctcattatttccgtcttccattgctcgtttccagtccactacgtttgcatcaataagcgactgaatcattaccagatcgccattgctcagtatgaaagtgagtaggttttcacgatcccacctctcaatcggcggtgtgatcaatatttctggattatgggttacctcgcttattagcgattccgttttggctaacaacaccatcgcttcgagcctgcgcagaggaatagtgggagggtgtttctgccaaaaataagcaaccaactcagtgttacgttggataatgggataaatatagacagtatcattcaacagttctggcataatattcagcaatagctgactaatttctagtctgtactgctcgcgatactgtgatatatagttagatttataaagcgtcagcagtggattttctttacgagcaacaatattgcgattctctctggcggaagatgtctcgcccaccagttgctggctaaaaaagcgtactatcggtacgttatgttggcgaagagcggtagcaaatggcgtataaagaaattcggcgttcgggatcgccgcttcagggcaagattctgccgctgtcaaaaatggcgaaatacctcgtattttagccagataacgcaataaattttccggtgtatcgcggtgttctgcagccagcgtcaaaacacttgccaattgataacaagatgcatcctgcaaaacctgaacatcccccttcgcgcgctcaaacagtcgggtaattttatagttatctcagtcttcaccaatgtggtgccataatcgcgggccgtccatcacataaacgaaaacgaacaaaaaaatagtatgggacacgatagttcccagtataaaaaatggagactctcgactagaaaaaatagcaattattatcgagggcagcaatcctgatatcaataaatatacgatataaatatcttttgaatcaatccagaataatcctccccacactacacagacaacgctcacctgcggaagaacaacacgcaagaaaacccgccgatagcgcaaagaatcaaatgcgccgacaattaacctcaataatacaacgccataaataccccacgcgctcatcaatattactgaatcccacatcatccacgcaaatgattcacccataaagtatccttactttccatgctcattactgagttcaaattcctcgttcctattttccgataacacagcgagctaaacgcactaataactatagtaaatacaatgattgtatatattgcccggcacggaggatattatcatcaacaacaaactccatccgtttcccaaattcattattgcccgctattttttctgatgataaaacacatcaaattcaaactgccatgagaaaggttccggtttgttgctattatcaaaggcaacggcttgtgcatacagttcgtccgtcaataattccggcacgacgctaatcaaactggtacaaatatctcgcgccaaaagttgttgttgcagaaaagtttgttcatcagccgtactatcattaaaaacacgattcagtaggtccaataatggattgttttgtaagagctgatgccgatattgctttgcctgtacagaatcgccaataaaccaggaggcaaacgtcccaacagcagaacgattaagccggtcgatggccaaaaccaaccaaattttttcagttccgcccgcaatatcaaaaggggaaatgcgttttgcgagatgctcaatccgcctattcgtcccccaatcccctgcgttttgcggctgcatggcttgcgacatcaaatgatttaaaaaaacgcggtcatcagtcgtatcgatttttcgtaacagcgtttcttccgccacctgctgtgcctgataggcatcgcgccgatgatgcctatcgagaatatcccccatgtgcgccaacaacagcagcaatacgaccacatagcacccggcccaaaggtggtgtggttggcgtaatcggtggctaaacagtagcgccaacaataaactaagccccagcatccaccctgcactaatcggaaagaaaagcgtttcatcatccgcagcaaaccatagcaaaagaaccagcgcaatctatggcaaagcaatccacagcaacacgcgacgaggcgtttggaacaaaaaagccaggcaaataacaacgaagagcagaataagatagccgcctgtagtaaacatccagaacgtcagtagccgccatccctcttcattgattctcatcgaatatccctggttcgcctttacgacgccggattcaccagcatttgcccaatcgagccgcgatcagccatttccagcgtctggctgttgaaatagaacgggaagtgcggccaggacggctgaccgtagtagaccagcaattcgacttgcccatccacccagacggtatctttccagcctctatcttccgggaacggcatagcgccgttgacgttacgaatcaggaaagagacgccctcaatatggaacgactgcggcatatcggcgcgtaccgtccagcgctcccaggtgccttgttgggcggtaatatcaatgcgattcacatcccacagttggccgttaatccccggatcgtcgccaagactgatgtcccgactgcggacaggcgcgccgctcatgatctccgtcggcaacagacgcatcggcagattatcggtcaccagcggcagcaatccggttggccgtaacgtcagcaccagggtcgaaaccagaatactggaaggctcaaagaaaccgcgaatccgatcgactatgctggccgcttccccgcaggtgatcgagacttcgtcgccgttggtcatatcaaccaggatttcacgtcgctcgccgggcgccagtgacaactgtttgacggaaaccggcgcaggtaaaaagccctgatcgcctgaaatcacatgcagcgcccggccatcgctcatctgaagctgatagcgccgcgagttcgaggcgttcaacaaccgtaaccgcacccagccgcgggacacttcgacataggggctttgcgcgccgttcaccagcagcgtatcgccgacaaaaccaccgctgcccggttcgctgtactccggcgtcccaaagttatccagccgtttatcctggataataacgggaaaatcatccacgccgtaatggttcggaatgggcagcgttttactgatgtcatcttcgaccagccacattccggccaggccgttatacacctgctgcgcagtgcggttaggcgtgttagcgtgataccacagcgtcgcggcgctctgacgaatcggcaacaccggcgcccagtccgcgttcggcgacatcatacgcgccgggccacccatcagcggccccggcaccagtaaaccagcaaccgtcatggagacattttccgccaggcggttgctatagatgagtttaacgtcatcgcctttccagacgcggattgtcggccccagataacgaccgttcactccccagaccggcgcgcgcgtgccttgcgtaaaggaccagtgcgctcgctgtagcgtcataaacaacggctgcccgcgacgggactccagcaacggcggaacaggcaacggctgttgctgaccggcagcattcgccctgaggggaatcgcgcctgcacatagtgcgattcccgatgcctgaagaaactgacgccgactgaatgacatataagctccatgtaaaacaggctaaagagttgtgcctgaaaaaatgatttctacaataacagagtaaggctgcttaaaccttaccggtcgcttcacgttccgcaacctctttatcaagttccgcgattttttgctccattaacgcacggcagtgggccgccagctcacgaacctgatctttaccatattcgctgacgtcgactggcggcagcatttccacaataaccagtccgttgttcaggcggtttagattgactttgttagaggtgttggaaacgcagacaggaatgatcggcacaccagccgcgatagccgcatgaaacgcgccggttttaaacggcagcagaccgcgtccccggctacgcgtaccttcagggaacatccagatagaaatacggcgctttttaaaatggttaactactgccgcaatggtgctatgcgctttggcgcggttattacggtcaatcaacagattaccggtcagccagtacagttgcccaaaaaacgggatccaaagcaggctttttttccccaccgtcaccgttggcggctgcacaatattcgccgccgtgaccatatcataattattctgatggttagcaatatagatagcattgccatagttttccgcatcggcgggtttgcggcactccactttcaggccaaacagcggggccagacgaccgaacatatgtccaaacgtcgccacgtgttttgggttacgtgggctgaaaaggcagtaaatagaaccgaaaacacagaccagaatggagtaaataacggtaacaataagacgaaaaatatatagcataacaacctctgaaggcctaagagcccggcattctacgtcacctgaaattcaggttaggattttggtaagtgtggctctctggaaaaacgtattgttaatcgcaatgcacgaataaacaacggttttacgggaaattttaatgttaatccgatctgaaaccgtaggccggataagacgctactgcgtcgtcatccggcaacggcagagcgccggatggcggcttagatgccttgtccggcctacgggcgcccctgtcttactcttcgctgtcgccatgacttacgcgatgcggcgaatcaatctcaatgcgatcgatacgctgcaggccgcgcattaatgtgccacggcgtccgcgttcaccgaccaccttttgtaactcttcagggcgcagtttgattttgcgcttcccgacatggatagtcagagtgctttgtggcggcagcacgtacaggtgcgccagtccatcatcgcctttcgccgcttccgcagaggggatattaatgatcttattgcctttgcctttcgacagctgcggcagagagtctaccgggaacatcaacatccgtccggcctgggtaatcgccagcagcatatcgtgctcgtctttaatcaccagcggcggcatgacgtgcgcattttccggcagtgtaatcaacgtcttaccggcacggttacgggcaaccagatcgttaaacgtacaaacgaagccgtagcccgcatccgacgccatcagcagtttctggtcatcgccttccatcagcatatgctctacggtcgcccccggcggcagcgtgagtttgccggtcagcggctcgccctgcccacgcgccgagggaagcgtaatgggatcaatagcatagctgcgcccggtggtatcaataaacaccaccggttgattgctcttacctttcaccgcggctttaaagctgtcgcccgctttatagttaagccccggcgcatcaatatcatgacctttggcgctgcgcacccagcccatctgcgacagcacgatagtcaccggttcggacggcagcatatcgtgttcgctcatcgctttagcttcttcgcgctcacgcagcggagaacggcgatcgtcgccataggcatcggaatctgcctgtagctcttttttcagcaaggtattcattttgcgttcggacgcgagaatgccctgcaactggtcacgctctttttccagctcgtcctgctcaccgcgaattttcatctcttccagtttggcgagatgacgcagtttcagttcgagaatcgcttccgcctgggtttcgctgatgccgaaacgcgacatcagcgcgggtttcggctcatcctcgttacggataatctcgatcacttcatcgatgttgagaaacgccaccagcaaaccttcgaggatatgcaggcgcttaagcactttctccagacgatagttcagacgacggcgcaccgtgtcgcggcggaacgccagccactcggtgaggatctccagcaggtttttcaccgccggacgaccatccagaccgatcatgttcaggttaatacggtagcttttttccagatcggtggtggcgaacagatggttcatcacctgttccatatccacacggttggagcgtggcacaatcactaaacgcgtcgggttttcgtgatccgattcatcgcgcaggtcgtccaccatcggcagttttttattgcgcatctgcgcagcaatctgctccagcacttttgcgccagatacctgatgcggcaacgcggtgatcaccacggcgccgtcttctttggtccataccgcgcgcatacgcacggagccacgcccattttcgtaaattttacgaatttccgcacgagggataatgatctccgcttcggtcgggtaatccggcccctggacgatatccagcaactgatccagcgtcgttttcggctgctcaatcagcgtaatcgccgctttcgcgacttcgcgcaggttatgcggcggaatatctgttgccatgcccaccgcaataccggtggtgccgttcagcaggatgttcggcagacgcgccggtaacattttcggttcctgcatggtgccgtcgaagtttggcacccagtccgcagtcccctgaccgagttcgcttaacagcagctcggcgtatttggacaggcgggattcggtataacgcatcgccgcgaatgacttcggatcatccggcgcgccccaattcccctggccatcgaccagcgggtaacggtaagagaacggctgcgccatcagcaccatggcttcatagcaggcgctgtcgccatgcgggtgatacttacccagtacgtcgccaacggtacgggcggattttttaaatttagcggtggcgttcagccccagctctgacatcgcatagacgatgcggcgctgtaccggcttcaggccgtcgccaataaacggcaacgcacgatccatgatcacgtacatggagtagtttaagtaggcgttttccgtaaattcatgtagcgcaaggcgctctgccatatcgctcattaacaggggatcctcaatctgcatgctgaccgttcggacggcaatattgccgcagataataccctatctcacggtctgagtcacaaaccgtgagacaggttgcgaggaagttaacgaagcggcagatagatatccgtcagcagctcatgttccgccacctcatggacgaaattcaggtactggaagaagaccggaaaatcgcgcagcgtctcgccgctggccggtagccattcgcggaataaataccacacgctctccgggaggctgtcgagcgatccctgatggcgcaccaccgcgcagcgcccgccaggaatctcgctattcaccacgccaacgtcattttcggctatcggctggcggacgctgccgcagatatcaaagcggaattgagccggcggcgtcgtctgcgggtcgtgccaggcaataccaaaagtttgactgctggcaatcggcgactggcccgtttcgcgtcgccatgcaataaatttcgccgcgctggcgttgaccttatccggatgccccagatgcgtcagcatcgcgacgcgggtaggaggaaattcaacgatttttacgtccatgacatgctgctcctgtaacgcaagtttaggaacgcgttggtgccaggccagccagtccggcgattgccgaaaccggcacgggctttgaccaaacgcggttttgaaagcacgtgtgaacgactccggattctgaaatccggcatccagcgcgatatcgataactttatcttgcggattaaacgccagccgccatgacgcccggcgcaaacgcagccactggatatagcgatagagcggaagcccgctccagacggtaaactgccggtgaaaatgaaacggcgagctgtgcgccatccggcttaacgcctcaagcgacagaggctcatccagatgacgctcaatgtggtcgcaaacgcgccgcagacgttcggaataagccgcgctgatcaggtcattcatcactgcctccttgtggcctattctgcccaccgggcggctgtgaatcctgaccgatcttgcgcaatgtgggattacggattcactttacgaatctgtttcacgtcgatttcgacagagttccagtctttatccacttcaccctgaatttcaacggtatcctgcggggttacggtcaggccgttccagcgcttgtggtcaatgtccacattgatagtaccggtcgcatctttaaacacatacaggtcgtcggaaatgcgctcgacgatattcccgcgcagcgttacccacgcatcgtcacgcagcgatttagcgctctctaccgtcgtgctgctgccgttcgggccgacaaatccgccgccctgcgtttgcgtcgccgacgggccggagaaaccgccctgctgagccgccagaaccggggtagaacacagtgccataacggcaacgattgcagctaattttttcatgattacttttccctttcatgtcgtttcagatccatttaataaggtaatccttaacaacttcttaaggcaaaaaaagattctttttttctgtacatcgcctgcggcgacaaggttaactgacggcaacgcgagttaccgcagggaagaacagatgcgaattttactggtagaagatgacacacttattggcgatggcataaaagcaggtctgagtaaaatgggtttcagcgtcgactggtttaccgagggacgtccgggcaaagaggcgctttacagcgcgccttatgatgcggtcattttagatttaacgctgccaggaatggacggacgggatattttgcgcgaatggcgcgaaaagggtaaacaggaaccagtactgatcctgacggcgcgcgacgcgttagcagagcgcgtcgaggggctacgtctgggcgccgatgactatttatgtaaacctttcgcgctcattgaggtcgccgcccgtctggaggcgctggtacgccgcgccagcggtcaggccagtagcgaattgcgccacggccaggtgacgctcaatccaggcaatctcgtcgcgacgcttgccggcgaaccgctggccctaaaaccaaaagagttcgcgttgctggaactcttactgcgcaacaaaggtcgcgtgctaccgcgcaagcttattgaagagaagctgtataactgggatgacgacgtgtccagcaatgcagtggaagtccatgttcatcatttacgccgcaagctcggcagcgaatttattcgcaccgtacacggcatcggctacaccctgggtgacgcatgaaattgacgcaacgtctcagcctgcgcgtcaggctgacgcttattttcctgattctggtctccatcacctgggcaatttccagttttgtggcctggagaaagacgacggataatgtcgatgagctgtttgacacacagttgatgttgttcgccagacggcttagcaccctcgatcttaacgagctcaacgccccgcagcgcatggcgcatacgccaaagaaattaaaacatgggcatatcgatgacgatgcgctggcgttcgccatcttttccgctgacggcaaaatgttgctgcatgatggcgacaacggccaggatattccgtatcgctatcgccgggaaggtttcgacaatggctatctgaaggatgacaacgacctctggcgttttttgtggttgaactcggcggacggcaagtatcgtatcgtcgtcggtcaggagtgggattaccgcgaagatatggcgctggcgatcgtggcggcgcaattaacgccgtggctgatcgcccttcccttcatgctgctgattttattactcctgcttcaccgcgagctcagaccgttgaaaaaactggcgcaggcgctgcgcttccggtcgccggaatcggaaacgccgctcgacgccaaaggcgtaccgagcgaggttcgcccactggtcgaagcgcttaatcagctttttagccgcatccactccatgatggtgcgcgaacggcgatttacctccgacgccgcccatgaattgcgcagcccgctggccgcgctgaaagtacaaaccgaggtggcgcagctctcgggcgacgatccgctatcgcgtgataaagcgctgacccagctccatgcggggatcgatcgcgccacgcggctggtcgatcagctactgacgttatcgcgtctcgactcgctcaataatttgcaggatgtagcggagatttcgctggaagagctgctgcagtccgcggtaatggatatttatcatccggcgcagcaggcgaatatcgacgtgcgtttacagcttaacgcccatgacgtcatacgtaccggccagccgctactcttaagcctgttagtgcgtaacctgctggataatgcgattcgctacagtccgcagggcagcgtcgtcgacgttaccttacatgcccgcagcttcaccgtcagagataatggccccggcgtagcgccagagattctaacgcatatcggcgagcgtttttaccgcccgccaggccaaagtgtgaccggcagcggtctgggattatcaatcgtccgccgcatcgctacgctgcacggcatgacggtgtcgtttggcaacgccgcggaaggtggatttgaggccgtagtacgctggtagcagagatttttgccaaaaacgcaaaagactttgcacattttgctaatttcaccgcaccgcccgtcagcgtagaatcagcagcaaacgcatttcttgaggacacaaaatgagtaacatcctgattatcaacggggcgaaaaaattcgcgcactccaacggccagttgaatgacaccctgaccgaagttgccgatgggctgctgcgcgatctgggtcatcaggttaagatcgtccgcgccgacagcgactatgacattaaagaagaggtgcagaatttcgtctgggctgacgtggtgatttggcagatgccaggctggtggatgggcgcgccatggacagtaaaaaatatatggatgatgtctttaccgaaggtcacggcacgctctatgccagcgatggccgcacgcgttccgatgccgctaaaaagtacggttccggcggtctggtgcaggggaaaaaatatatgctgtcactgacgtggaacgcgccgatggaagcatttaccgaaaaagatcagtttttccacggcgtaggcgtagatggcgtctatctgccattccataaagccaaccagttcctgggcatggacgcgctgccaacgtttattgccaacgacgtgattaaaatgccggatgttccgcgctataccgcagaatatcgcaagcatcttagcgaaatttttgcttaactggtcatcctggaattagaaggagttaaccatgcttaccgtcattgccgaaattcgcacgcgtccgggccaacatcaccgtcaggccgtcctcgatcagtttgcgaaaattattccaaccgttcttaaagaagaggggtgccacggttacgcgccgatggtggatcatgccgcgggcgtgagttttcagactctggcgcctgactcgatcgtgatgattgaacagtgggaaagcgttgcgcaccttgaagcgcatctgcaaaccccgcatatgaaagcctatagcgacgcggtaaaagacgatgtgctggaaatgaatattcgtattctggaatccggcgtttaagttattaccctcgtctgacgtcgccctgatgcgatgcgcaagtgtcgccatcaggctgcgacgtcatgtcggattctcttatccggcctgcggcgcgcagaccggataaagcgtgcaacaatcgttacacgtcgagatccgcgagatcgcctttttcctgtagccagttgcgtcgatcttcagaacgtttcttcgccagcagcatatccatcatcgcattagtacgctgatcgtcttcatcgctaatggtgagctgcaccaggcggcgagtattcggatcaagcgtggtttcgcgtaactgcatcgggttcatttcacccaggcctttgaaacgctggacgttcggcttgcctttcttacgcttcagttgttccagtacgcccgccttctcttcttccgtcagcgcgtaatagacctctttacccaaatcgatacggtatagcggcggtagcgcgacgtagacatgaccattcttcaccagcgcgcggaagtgtctgacaaacagcgcgcaaagcagagtagcgatatgcaaaccatcggagtccgcatccgccaggatacagatcttgccgtagcgcagctgactcagatcgtcgctgtccggatcgataccgatcgccacggaaatatcatgcacctcttgcgaggccagcacttcatcggaagagacttcccaggtgttaaggatcttacctttgagcggcatgatcgcctgatattcgcgatcgcgcgcctgcttggcggaaccgcctgccgaatccccttccacaaggaacagctcggttcgattaagatcctgcgcggtacagtccgccagtttccccggcaacgccggaccgctggtgagttttttgcgtaccactttttttgcggcgcgcagtcgccgctgcgcgctggcaatcgccatctctgccagttgttccgccgcctgcacgttctggttcagccacaggctgaaggcatctttcaccacgccggaaacaaatgccgcacattgacgcgacgacagacgctctttggtctgcccggcaaattgcgggtcctgcattttcacggagagcacataagcgcagcgatcccagatatcttccgccgacagtttgacgccgcgcggcagaatattgcggtattcgcaaaattcgcgcatcgcgtcgagcaggccctggcgcagaccgttgacgtgcgtccccccctgcatggtcgggatcaggttgacgtagctttccgtcagtaattcgccgccttccggcagccacaatagcgcccagtcaaccgcttccgtttcaccgttaaaattaccgataaacggcttttccggcagcgtcggcaggccgtttaccgcttcgcccagatagtcgttcagaccatcctggtagcaccagcgctgctcgctgttattcacttcatctttaaaagtgatttccacgccgggacacagcaccgcttttgctttcagaacgtgcattaagcgagagacagaaaaacgcgggctgtcgaagaaactttcgtccggccagaaatggacgctggtgccagtattacgtttaccgcaggtgccgacaacctgcaaatcctgcactttttcgccgttttcaaacgcgatgttatagacctgaccgtcgcggcgcacggtcacttccacgcgctttgacagggcattcacgaccgaaatccccaccccatgcagaccaccagagaactgatagttcttattggagaatttaccgccggcatgaagccgacagaggatcagttctaccgccggaaccccctcttccggatggatatccaccggcatcccgcgtccgtcgtcaatcacttccagcgattgatcggcatgtaaaatgacatccacgcgtttggcgtgacctgccagtgcttcatccacactattatcaattacttcctgacccaaatggttggggcgggtcgtatcggtgtacatccccgggcggcggcgtaccggctcaagcccagtgagtacctcaatggcatcagcgttataagtttgcgtcatggtttaattagcaattcgaattgattgtcagcaactgtgcagtccaagaaaatcgacaatctggttgaaataatcttcgaagcccgtgaatgcgtgattacccccctcggtcactgtctgacggcaggaggcgtaatatgccaccgcctggcggtaatccagcacttcatcgcccgtctgttgcagtagccagatcaggtccggcgcttccagcgggtcaatctgcatgactttaagatcataaatatggcgagactctagcacatattgctgcccggtgtaggggttctcgttctgaccgagatagtcggtcagtaattcaaagggccgcacggcgggattcaccaccacagccggcagcataaaacattgcgacagccaggtggcgtaataaccacccagcgacgatcctaccagccctaatggcgcaccgccatgctcaagtacgagagattccagcaactccgccgcatcggcaggatacggcggcagttgagggacgatcatctcaacatgcggatgacgctccgccagccagttttttagctggcacgcttttgccgagcgaggggaactgttgaatccgtgcaaatagagaagcgtagacatcagtatccttccgaagcggtatcgggtcggaaccgggtatcctgcaggcgatgcacttccgtctccaggacgccgttcgcctggagctccagcgtacgccagcccggcgcgatagtatccagcgtaaagttcgcgcagtgcggtttgaactgtacgcaggttgacggcgacgccaacagacggcgaccgttccagtcgagatccagctcctggtgaatatgtccgcatagcagatactttacacgcgggaaattcgccagcacgctatccagctcaccagcattacgcaagctgtgctgatccagccaactgcaccctgccggcaacggatggtggtgcaacaggagcaatgtctgtctctctggcgcatcggcgagcttacgctcaagccattccagttggaactcgctcagttcgccatgcgggacgccaaacacctggctatccagcaacaaaatctgccattgttcaccgattaacacgcgtttagccggggaaatccccgcctcttgcagcgcgctgtacattgccggctgaaaatcgtgattgcccggtagccaaacgcaaggcgcgcgaaagcttgcgataccctcagcaaaatgctgataagccgcagcggattgatcctgcgccagatcgccggtcgccacgatcagatcatattcatactgttgcgcccgaatagcctccagcacggcctggtaactttcccaggtattgacgcctaacagcgtttcatgcttttcggcaaacaggtgagtatctgtaatttgtaaaatcctgactcgggcctcaccagccagaggtagggttaacaggctttccaaatggtgtccttaggtttcacgacgctaataaaccggaatcgccatcgctccatgtgctaaacagaatcgtagccagtcggccagaaactgattaatttgatgcttttcgtcgcgttgatgcaactttttatttggataatcataccgcgctttgaagcgaaagatctgctggcttgaacacacttcagccaccatcgcatcatggtagaggcgcaccgtcagcgacggcaggctccagtaggtgatggctggcgccgtttgctcgatcgttacaagcgtagtgtatcgggtcaattccacaatcgttaaccgatattgtacgttgcccacctgatagctcaccgtttcaccgggggcgtcattgcgcggcagcaggcggcgcaattgcgaaaaattggtttcgcacaaacgcatcatttctgggaagtcaggtgtataacgcttcattttttccactcgttttttaactcttgatgatgcaactgaagccattgcaaagcgatgactgcggctgcgttgtcgattttcccctcttctacccactggtatgcctgttcccggcttaccacatgaacccgaatatcttcgttttcatccgccagaccatgaatacctaccgcggtcgtggcgtccacttcacccaccagaatagatgagcgctcgctggttcctcctggactcgccaggtaactgatgaccggtcgggtgcggcctacggtcagccccgcttcttccatcgcctcccgccgggcgaccgcctcaatggtttcgccttcttctatcatgccggcgaccatctccagcagccacggcgtaacgcttgtgtcatatgcggcaatacgaatctgttcgaccagcaccacctcgtcgcgttcagggtcaaagggtagcaagacggcggcgtgcccgcgctcaaaaatttcgcgctttacctcgccactcatttctccgttgaataaacgatggcggaatcgatacacatccaatgaaaaaaaaccgcgatagcgcgtttcccgtgcaataatttctacatcgcttttggtgaaagtaactggcaagttgtctgatttacgcattgtgctgccctgctagcaataatgattaaatgatgaatttcaagggtggttgactgctgttttatcacccttgtggtaaattggtgccaattaaggctcgtatggcacgtaacgccaactttttgcagtggcggattctgctagaatcagcaattatttttacaaattgatcagcgctaaatactgcttcacaacaaggaatgcaaatgaagaaattgctccccatccttatcggcctgagcctgtcggggttcagcacactaagccaggcagagaacctgatgcaagtttatcagcaagcacgcctgagcaacccggaattgcgtaaatccgctgccgatcgcgatgctgcattcgaaaaaattaacgaagcacgtagtcctttactgccgcaactgggtttaggtgccgactacacctacagcaacggttatcgcgatgcgaacggtatcaactccaatgaaaccagcgcttctctgcaattaacgcagacgctatttgatatgtcgaaatggcgtgggctcaccctgcaagaaaaagcagcaggcattcaggatgtcacctatcagaccgatcagcagacgctgatcctcaataccgcgaacgcgtattttaaggtattgaacgctattgatgtgctttcctatacccaggcgcaaaaagaggctatctaccgtcagttagatcaaacgacgcaacgttttaacgtgggtctggtcgccattaccgacgtgcaaaacgcccgtgcgcaatatgataccgtactggcgaatgaagtgaccgcccgcaacaacctggataacgcggtagaagagctgcgccaggtaaccggcaattattacccggagctggcgtcgcttaacgtcgagcattttaaaaccgacaaacccaaagctgttaatgcgctgctgaaggaagcggaaaaccgtaacctgtcgctgttgcaggcgcgtttaagtcaggatctggcgcgcgagcaaatccgtcaggcgcaggatggtcatctgccgacgctgaatttaacggcctcaaccggcatttctgatacctcttatagcggttctaaaaccaactccgcccagtacgacgatagcaacatggggcagaataaaatcggcctgaacttctccctgccgctgtatcaaggcgggatggttaactcgcaggtaaaacaggcgcagtataacttcgtcggcgcaagcgaacagctggaaagcgcgcaccgtagcgtggtgcagaccgtacgttcttcctttaacaatattaacgcctccatcagcagcatcaacgcgtataaacaggcagtcgtttccgcgcaaagttctttggatgcaatggaagccggttactcggtcggtacacgtaccattgttgacgtactggatgccaccaccactctgtatgatgccaagcagcaactggccaacgcgcgttatacctatttgattaatcagttaaatatcaaatatgcgctcggtacgctgaacgagcaggatctgctcgcgcttaacagtacgttgggtaaacctatcccgacgtcgccggaaagcgtagcgccggaaacgccagagcaggatgctgccgcagacggttataatgcccatagcgccgcgccggcagtacagccgaccgccgctcgcgccaacagcaataacggcaatccattccggcattgataagttattcgctggcgctgcgtttatcagacctatgcccttgtaggtctggtaagcgcggcgctacctgtcataaagccgcgcctgaacgtaagacaacgtaaagatcctgctattccgccgcattctcgccttttctcgcttcaatttcgaccagtcatcctctattctgaacgcatgttgtatttaccactgggtcctggaagacaaatatgaaacggacaaaatccatccatcacgcatcatttcgcaaaagctggagcgcgcggcatttaacgccggtcgccctggcggttacggctgtttttatgctggctggctgtgaaaaaagcgatgaaaccgtatcgctgtatcaaaacgctgatgactgttcagcggcgaatccgggcaaaagcgcggaatgtacaaccgcgtataacaatgcgctgaaagaggccgaacgtactgcgcctaagtacgctacacgcgaagattgcgtcgctgagtttggcgaaggccagtgccagcaagcgcccgcacaggctggcatggcgccggaaaatcaggcgcaggcccaacaatccagcggcagtttctggatgccgcttatggcaggttacatgatggggcgtctgatgggcggcggcgcaggctttgcgcaacagccgctgtttagctcgaaaaacccggccagccctgcatacggcaaatataccgatgcggcaggtaaaaactacggggcggcgcaaccgggccggacaatgaccgtaccgaaaaccgcgatggcgccgaaacctgccaccacaacaaccgttacccgcggcggttttggcgaatccgtcgccaaacagagcactatgcagcgtagcgctgccggtacttcaacacgttcgatgggcggctgatacgcatggaaagagtcagtattaccgagcgcccggactggcgcgataaagcgactgaatacgggtttaattttcacactatgtatggtgaaccgtactggtgtgaagacgcttattacaagttaacgctcgcccaggtggaaaaactggaagacgttaccgccgagctgcaccagatgtgcctcaaggtagtagaacgcgtcatcgccagcgatgagctgatgacgaagtttcgtattccaaaacatacctggggttttgttcgccagtcctggcaaacgcaacaaccgtcactctattcccgcctcgatttggcctgggacggcatcggcgagcctaagctgctcgaaaataatgccgacacgccaacatcgctgtatgaagcggcgttttttcagtggatttggctggaagatcagatcaacgcgggcaatctgccggaaggcagcgatcagtttaatagcctgcaggaaaagctgattgaacgctttgctgaacttcgcgaacagtacggttttcagttgctgcatctcacctgctgtcgcgatacggttgaggatcgcggcaccattcagtatttacaggattgcgcggccgaagcggaaatcgccaccgaatttctctatatcgacgatattggtctgggggaaaaaggtcaatttacggatctgcaggatcaggtcattgcgaacctgttcaagctctatccgtgggaatttatgctacgcgagatgttttccaccaagctggaagatgccggcgtgcgctggctggaaccggcctggaaaagcattatctccaataaagcgttattgccgctgttgtgggagatgttcccggaccatccgaatctgttgcctgcgtatttcgccgaagacgaacatccgccaatggataaatatgtcgtgaaaccgatcttctcccgcgaaggggcgaacgtatcgattattgagaacggtaaaacgatcgaatccgtggaaggcccgtatggcgaagagggtatgatcgtgcaacagttctatccgctgccaaaattcggcgacagttacaccctgattggtagctggctgattaacgatcaacccgccggaattggtatccgtgaagatcgggcactgatcacccaggatctctcccgcttctatccgcatatttttgtcgaaggatagattttcctgtaagcccgatgcgcgtagcgccatcgggcaatcattcagcgccttatccggcctaccccacctgcaccgacaacatacttatactgcccatctcaataccgtcgaccgggatggtgataggttccttgccgtcccaggcgccaagtacatacagcaaaggcaaaaagtgctccggcgtcgggttcgataaggcgcccccttcatgttgcagataattcaccagcgggtgctgttctaccggcccctgccacgtcaggttagctttcacaaagtcattaaatgacgccgcccagggatacggtatattgtcaccgtgccaacgcacagtccgcaggttatgaaccacattcccgctagccaccagcatcacgccttcgtcacgcagcgtcgccagtttacgacccatctcaaaatgccatgccgccggtttggtactatcaacactaagctgcaccatcgggatatccgcattcgggtacatcttgatcaatacgccccaggagccgtgatcaaatccccacgcctctttatcgagcgcgacgggaacgggagccaacagttcaaccagacgctgcgccagcgcaggcgatccaggggccggataatgcatgtcatacagcgcctgcggaaaaccgccaaaatcgtggagagtttgcggcctttccatcgctgtgacgcccgtcccacgggtataccagtgcgccgacaccaccactatcgcctgtggtcgcggtagggcttcccccaatcgccgccaggcgcgggtataatcattatcgtccagcacgttcatcgggctgccatgccccaaaaacaatgctggcatacacgttaaagacatgatgctatccttacaggaaagacattttgttaacatcaccatacgctttcttcacagaggaagaactcagataactatgatgaagatcatcagttattttgaaggtcaggttcggacggcaaattgataaggagtaatggatgtcagtaccacttattctgaccttactggcgggcgctgccacctttattggcgcgtttcttggcgttcttggccaaaaaccgtctaaccgcgtgctggctttttcgctgggcttcgccgcagggatcatgctgctcatctcgctgatggagatgctgcccgccgcgttagataccgaggggatgtcgcctgtactgggctacgggatgtttattatcggcctgttgggctacttcgggctggatcgtctgcttcctcacgctcatccgcaggatctggtgcaaaaaaggcagcagccgcttcccggctcgataaaacgcactgcgattttattgacgctcggcattagcctgcacaactttccggaaggaatcgccacctttgtcactgccagcagcaatcttgaactgggtttcggcatcgcactggcggtggcgttgcacaatattcctgaagggctggcggttgccggcccggtttatgccgcgacgggctcaaaacgtaccgcgattttttgggccggtatctccggcatggcggaaattcttggcggcgtgctggcgtggctgattttgggcagcctggtttcaccgatcgttatggcggctatcatggcagcagtcgccggcattatggtggcgctctccgtcgatgaactgatgccgttggcaaaagagatcgatcctaacaataaccccagctatggtgtgctttgcggtatgtccatcatggggctcagtctcgtcattttgcagacgataggtatcggttaagagcaacgtcgcgccggatgcaggcctttagccaggcaacatccggctgcccgtcaaggatatgcgctatttctgctcattcatcacgctgtcgccttcgctcgtctggcgaaaacgtttcgttcgcgcttcaagtaatgcatctctgtcttgccgaaacgctctgcaataacgcttcatatggcaaatataccctactaccaccagaacgattaatattatccaataccaggcaataaacatcctttttacccttaaaatttaacatcactaaacatttaacgttaaaattttacatacccttattttgacgtattcatatactggcatatttgtggaacaaataaatgattttgatcatataaatcagtggtgaaacacaataatgaaagaggtattaagcagaaaacaatgtcgataagatcacacttcgtactaatttatattgttcttaaaatatcacactcctactatcgactcactcaggcaattaaaaaatattgatacagaatatactttaaaataagtaacagcatcatgacttatatttaaagaccaatcatttacctcatttattattcataaaaacatagtatattcagaagtattatatttagaagttgtatataaggagatatatccatgtttgaccaataccggaaaacaatacttgccggcgccgtcgcactgacatgcggactcaccgcagccagtacgtttgccgcaggttttcaaccggcgcagcccgcagggaaattaggcgcagtcgttgtcgatccttacggtaatgcccctctcaccgcactggtggaattagatagccatattatttcagacgttaaagttactgtacatggcaaaggggaaaaaggcgttcccgttacttataccgttgggaaagagtctttagaaacctatgacggtattcctatttttggcctttatcagaaatttgccaacaacgtcacggtagaatataaagaaaacggcaaagccatgaaggatgactatgtggtgcagacgtccgccatcgtcaaccattatatggataaccgttctatttcagatctccagcaaacgaaagttattaaagttgcgccaggatttgaagatcgcctttatctggtaaatacccatacctttacgccgcagggcgctgaatttcactggcacggcgaaaaagataaaaatgcgggcattcttgatgccggcccggcgggcggggctttgcctttcgatatcgccccttatacgtttgtggtcgacacccagggtgaataccgctggtggctggatcaagataccttctacaacggccacgatatgaatatcaacaaacgtggctacctgatggggattcgtgaaacgcctcgcggcacctttaccgcggtgcagggccaacactggtacgagtttgacatgatggggcaaattcttgccgatcataaactgccgcgcgggttcctggacgcatctcatgaatccatcgaaaccgtgaacggtaccgtactgctgcgcgtcggcaaacgcgattaccgcaaagaagacggcatacatgttcatactattcgtgaccaaatcattgaggttgataagtctggccgcgtagtagacgtttgggatttaaccaaaatcctcgaccctatgcgtgatgcgctgctcggcgcgctggatgcgggcgcagtatgcgtgaacgtcgatctggcccatgccggacagcaggcgaaactcgaaccggatacgccgtatggcgatgcgcttggcgttggtgccggtcgtaactgggcgcacgtcaactctatcgcttatgacgcgaaagacgactccatcatcctttcttcccgccatcagggtattgtaaaaattggtcgcgataagcaggtgaaatggatactggcaccgtctaaaggctggaataagcagctagccagtaaattgctgaaaccggtagacgatcatggtaagccgttgacctgtgacgaaaacggcaagtgtaaggacaccgatttcgatttcacctatacccaacatacggcatggctttccagcaaaggtacgttaacggtctttgataacggtgatggtcgcggcctggagcaaccggctctaccgaccatgaaatattcccgttttgtcgaatataagatcgatgagaagaaaggcaccgtacaacaagtttgggaatacggtaaagaacgtggatatgatttctatagtcctattacctcggttgttgaatatcaaaaagaccgcgacaccatgttcggctttggcggttctattaacctgttcgacgttggtaaaccaacagtcggcaaactgaatgagattgactataaaacgaaagaagtgaaagttgaaattgatgtgctgtcggataaacccaaccagactcactatcgtgcgttactggtacatccaacacaaatgtttaaataaatcacgggaaggaattaatatgtcatctaaatggattacctctttatttaaaagcgtagtattaaccgcggcattggtcactccttttgcggcatcggcttttaccgagggcacagattatatggttctggagaaaccaattcctaatgcggataaaacgctgattaaggtatttagctacgcctgccctttctgctacaaatatgacaaagccgtaacaggtccggtttctgataaagtcgccgatctcgttacgttcaccccgttccacctggaaacaaaaggcgaatatggcaaacaggccagcgaagtatttgcagtcctgatcgccaaagataaagctgccgggatttcgttatttgatgctaaatcacaattcaaaaaagcgaagttcgcctggtatacggcttaccatgataagaaagagcgctggtcagatgggaaagatccggcggcatttattaaaaccgggctggacgccgcaggcatgagccaggctgattttgaagcggcgctgaaagatcctgccgttcaggagactctggaaaaatggaaagcagcctatgacgttgccaaaattcagggtgttccggcttacgtcgtcaacggcaagtaccttatctacaccaaaaacatcaaatccatcgattctatggctgaactcgttcgggaactggccactaaaaaataagcagggaaacgattatggattttattaagggattatggcgagacctacgcgcaagaccagtggatacgctggtgagatggcaggaacagcgctttctgtggctgttaatggccatcgcgatgggaggattaattatcctggcgcactcgttcttccaaatctacctctacatggcaccgtgcgagcagtgtgtttacatccgttacgcgatgtttgtgatggtaattggcggggtgattgcggcaataaatcccaaaaatattgtgctgaagctgattggctgcatcgcggcgttttatggcagcattatgggcattaagttttctattaagcttaatggtatccatcatgcggtacataatgcggaccccgattcactttttggcgtgcaaggatgttcgactgacccgacctttcctttcaacttaccgttggcggaatgggcaccggagtggtttaaacctaccggagactgcggttatgacgcgcctatcgtccctgatggcgtgacgctcagtagcgtacagcagtggtttgtcgatctctaccagcagtccgaaggctggtatctgcttccgccctggcactttatgaacatggcgcaggcatgtatgttggcctttgggttgtgcctgattctgctgctggtgatgagcggcgcctgggcattgaaactggccagaggcaaataacctgaatagataaaccaaagcagaggtctgcattcaggcctctgcttttctcacaataattttaccattcagcttattcgtcgttctttgaaactgaacaatatggcaccgaaggaatacaaaaaagccgatgagatgtcatcggcttttttcaaccatgatccgttcgatcagctggctttgcgctcatgcgcctggcggtaagccaccagatcttcaatcgtgaccaccgccatattatgctggcctgcaaacgcgatacactccggcgcgcgcgccatcgtcccatcgtcgttagtcaactcgcacagtacacctgcaggtttaaaaccggccagcgtcatcagatcgatggtcgcctccgtatgaccgccgcgcgtcagcacgccgcccgcctgagcgcgcagtgggaaaacgtgccccggacggttaagatcggacggttttgcgccatccttaattgccgcacgcaccgtagtgacacggtcagcggcggaaacgccggtggtcacgccttctgcggcttcaatggtcacggtaaaaccggtgccgtaggcgctggtgttgttttccaccatcattggcaaatcgagctgcttacggcgatcttcagtaatacacaggcaaacaataccgctaccgtgacgaatggttaacgccatctgttctacggtcattgtctctgcggggaaaatcatatcgccttcgttttcacgatcttcatcatcaagcaccatcacaccgcgtccttcacgcagcgcatccagtgcaagttcaacacgttcaaaaggcgtaccaaaagaggaaagtagcgtctgattcatggtaaaaaaacctcattaacattatggttaccagaatcagggcagtcttaggagtgccgacaagcggcaaaaaaataacgtgagcgggtccatgcccgactggatcgttaccctctcccatccggactttaaccgtcggccccggaattacaccggatctgctgaccttttcgctatggcaaaaagcgctcgcgggctttcaacctgctctccgcgttccgtcacggcgcaccgtgatgagaaatgcgttaaacatcgctgatttaccgccggtggggaatttcgccccgccctgagaataagcgggttaactataacgctattgattaccttcatcaacgcctttactccgtatgacatcacacaattctggtttatggcgtccacatatcgcactacaataagagctaacacttaccagttcagggaaaccacaatgattgacccgaaaaaaattgagcaaatcgcacgccaggttcatgagtcaatgccgaaaggtattcgcgagttcggggaagatatcgagaaaaaaatccgtcaaacgctgcaatctcagctgacgcgtctcgatctggtgagccgcgaagagtttgatgtccagactcaggtcttgctgcgcacccgggaaaaactggcgctgctggagcaacgcctcagcgaactggaagctcgcgacaagcctgaagaagtaaaacctgcgcccgccattccgccagtcgatccacaagagtaaaaacgtgaacgggcctgacggcccgctcatataagatctgaataatgccctgcgcctgtataagggagcctgcattagtgttctaattctaactttttcgcctgagtcgcctgctggcagtaaagcgcgtaacgcttgcaa
